(12) United States Patent
Chan-Hui et al.

(10) Patent No.: US 10,836,811 B2
(45) Date of Patent: *Nov. 17, 2020

(54) BROADLY NEUTRALIZING HUMAN IMMUNODEFICIENCY VIRUS TYPE 1 (HIV-1) GP120-SPECIFIC MONOCLONAL ANTIBODY

(71) Applicants: Theraclone Sciences, Inc., Seattle, WA (US); The Scripps Research Institute, La Jolla, CA (US); International AIDS Vaccine Initiative, New York, NY (US)

(72) Inventors: Po-Ying Chan-Hui, Bellevue, WA (US); Katherine Doores, San Diego, CA (US); Michael Huber, Zurich (CH); Stephen Kaminsky, Bronx, NY (US); Steven Frey, Redmond, WA (US); Ole Olsen, Everett, WA (US); Jennifer Mitcham, Redmond, WA (US); Matthew Moyle, Redmond, WA (US); Sanjay K. Phogat, Edison, NJ (US); Dennis R. Burton, La Jolla, CA (US); Laura Majorie Walker, San Diego, CA (US); Pascal Raymond Georges Poignard, San Diego, CA (US); Wayne Koff, Stony Brook, NY (US); Melissa Danielle De Jean De St. Marcel Simek-Lemos, Brooklyn, NY (US)

(73) Assignees: Theraclone Sciences, Inc., Seattle, WA (US); The Scripps Research Institute, La Jolla, CA (US); International AIDS Vaccine Initiative, New York, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/701,679

(22) Filed: Sep. 12, 2017

(65) Prior Publication Data

US 2018/0057570 A1    Mar. 1, 2018

Related U.S. Application Data

(63) Continuation of application No. 15/152,630, filed on May 12, 2016, now Pat. No. 10,087,239, which is a continuation of application No. 13/780,776, filed on Feb. 28, 2013, now Pat. No. 9,464,131, which is a continuation-in-part of application No. PCT/US2011/049880, filed on Aug. 31, 2011.

(Continued)

(51) Int. Cl.
| C07K 16/10 | (2006.01) |
| A61P 31/18 | (2006.01) |
| A61K 39/21 | (2006.01) |
| A61K 39/00 | (2006.01) |

(52) U.S. Cl.
CPC .......... *C07K 16/1063* (2013.01); *A61K 39/21* (2013.01); *A61P 31/18* (2018.01); *C07K 16/1045* (2013.01); *A61K 2039/505* (2013.01); *C07K 2317/21* (2013.01); *C07K 2317/33* (2013.01); *C07K 2317/34* (2013.01); *C07K 2317/51* (2013.01); *C07K 2317/515* (2013.01); *C07K 2317/56* (2013.01); *C07K 2317/565* (2013.01); *C07K 2317/76* (2013.01); *C07K 2317/92* (2013.01)

(58) Field of Classification Search
CPC ................................. C07K 16/1063
See application file for complete search history.

(56) References Cited

U.S. PATENT DOCUMENTS

| 7,041,293 B1 | 5/2006 | Berman et al. |
| 8,840,890 B2 | 9/2014 | Lewis et al. |
| (Continued) | | |

FOREIGN PATENT DOCUMENTS

| WO | 2010/056898 | 5/2010 |
| WO | 2010/107939 | 9/2010 |

OTHER PUBLICATIONS

Brown, et al. "Tolerance to single, but not multiple, amino acid replacements in antibody VH CDR2", J. Immunol. 1996,156:3285-3291.

(Continued)

*Primary Examiner* — Jeffrey S Parkin
(74) *Attorney, Agent, or Firm* — Duane Morris LLP; Thomas J. Kowalski; Deborah L. Lu

(57) ABSTRACT

The invention provides a method for obtaining a broadly neutralizing antibody (bNab), including screening memory B cell cultures from a donor PBMC sample for neutralization activity against a plurality of HIV-1 species, cloning a memory B cell that exhibits broad neutralization activity; and rescuing a monoclonal antibody from that memory B cell culture. The resultant monoclonal antibodies may be characterized by their ability to selectively bind epitopes from the Env proteins in native or monomeric form, as well as to inhibit infection of HIV-1 species from a plurality of clades. Compositions containing human monoclonal anti-HIV antibodies used for prophylaxis, diagnosis and treatment of HIV infection are provided. Methods for generating such antibodies by immunization using epitopes from conserved regions within the variable loops of gp120 are provided. Immunogens for generating anti-HIV1 bNAbs are also provided. Furthermore, methods for vaccination using suitable epitopes are provided.

4 Claims, 109 Drawing Sheets

Specification includes a Sequence Listing.

Related U.S. Application Data

(60) Provisional application No. 61/378,604, filed on Aug. 31, 2010, provisional application No. 61/386,940, filed on Sep. 27, 2010, provisional application No. 61/476,978, filed on Apr. 19, 2011, provisional application No. 61/515,548, filed on Aug. 5, 2011.

(56) References Cited

U.S. PATENT DOCUMENTS

| | | | |
|---|---|---|---|
| 9,051,362 | B2 | 6/2015 | Chan Hui et al. |
| 9,464,131 | B2 * | 10/2016 | Chan-Hui .......... C07K 16/1063 |
| 10,087,239 | B2 * | 10/2018 | Chan-Hui .......... C07K 16/1063 |
| 2008/0279879 | A1 | 11/2008 | Zolla-Pazner |
| 2010/0215691 | A1 | 8/2010 | Parks et al. |
| 2011/0044994 | A1 | 2/2011 | Chan Hui et al. |
| 2011/0223615 | A1 | 9/2011 | Lewis et al. |

OTHER PUBLICATIONS

Communication regarding extended European Search Report corresponding to EP 11822530.9 dated May 20, 2014.
Fanning, et al., "Development of the immunoglobulin repertoire", Clin. Immunol. Immunopath., 1996, 79(1 ):1-14.
Koefoed, et al.,"Molecular characterization of the circulating anti-HIV-1 gp120-specific B cell repertoire using antibody phage display libraries generated from pre-selected HIV-1 gp120 binding PBLs" J. Immunol. Methods, 2005, 297:187-201.
Partial European Search Report dated Jun. 22, 2015, which issued during prosecution of European Application No. 14004015.5.
Pejchal, et al., "Structure and function of broadly reactive antibody PG16 reveal an H3 subdomain that mediates potent neutralization of HIV-1", Proceedings of the National Academy of Sciences, Jun. 2010, 107(25):11483-11488.
Supplementary European Search Report corresponding to EP 11822530.9 dated May 20, 2014.
Walker, et al., "Broad and Potent Neutralizing Antibodies from an African Donor Reveal a New HIV-1 Vaccine Target", Science, American Association for the Advance of Science, Sep. 2009.
Walker et al.: "Broad neutralization coverage of HIV by multiple highly potent antibodies", Nature, Sep. 2011, 477(7365):466-470.
Walker, et al., "Supporting Online Material for Broad and Potent Neutralizing Antibodies from an African Donor Reveal a New HIV-1 Vaccine Target", Science, Sep. 2009.
Winkler, et al. "Changing the antigen binding specificity by single point mutations of an anti-p24 (HIV-1) antibody", J. Immunol. 2000, 165:4505-4514.
European Search Report dated Apr. 21, 2017, which issued during prosecution of European Application No. 16 20 6293.
Devin Sok, et al., The Effects of Somatic Hypermutation on Neutralization and Binding in the PGT121 Family of Broadly Neutralizing HIV Antibodies, PLOS Pathogens (Nov. 2013) vol. 9, Issue 11, e1003754, p. 1-20.
Extended European Search Report dated Jul. 17, 2019 issued in EP Application No. 19156884.9.

* cited by examiner

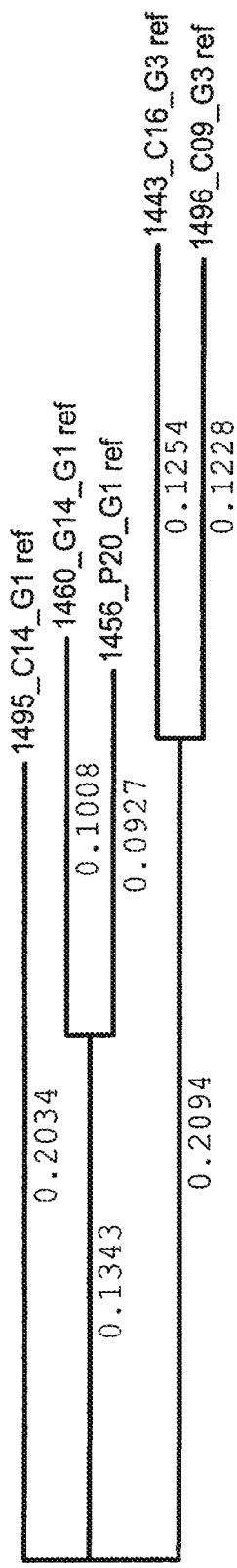
FIG. 1A  Heavy Chain Tree
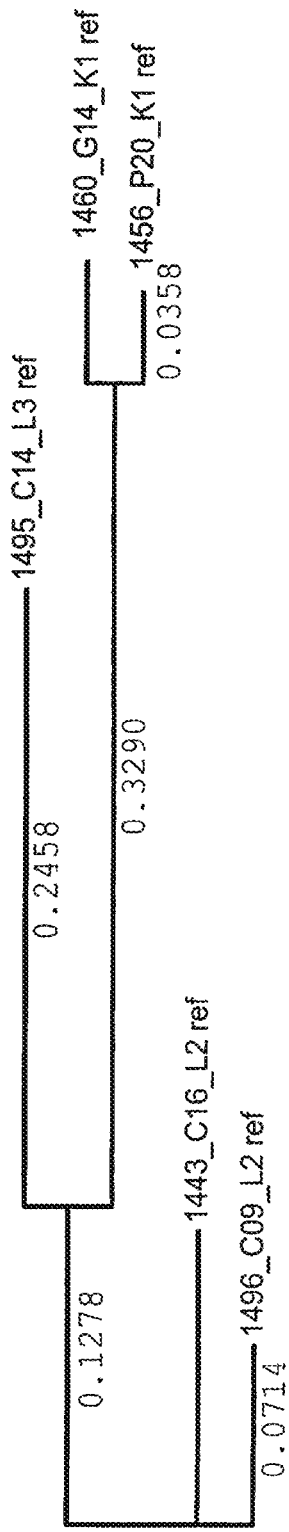
FIG. 1B  Light Chain Tree

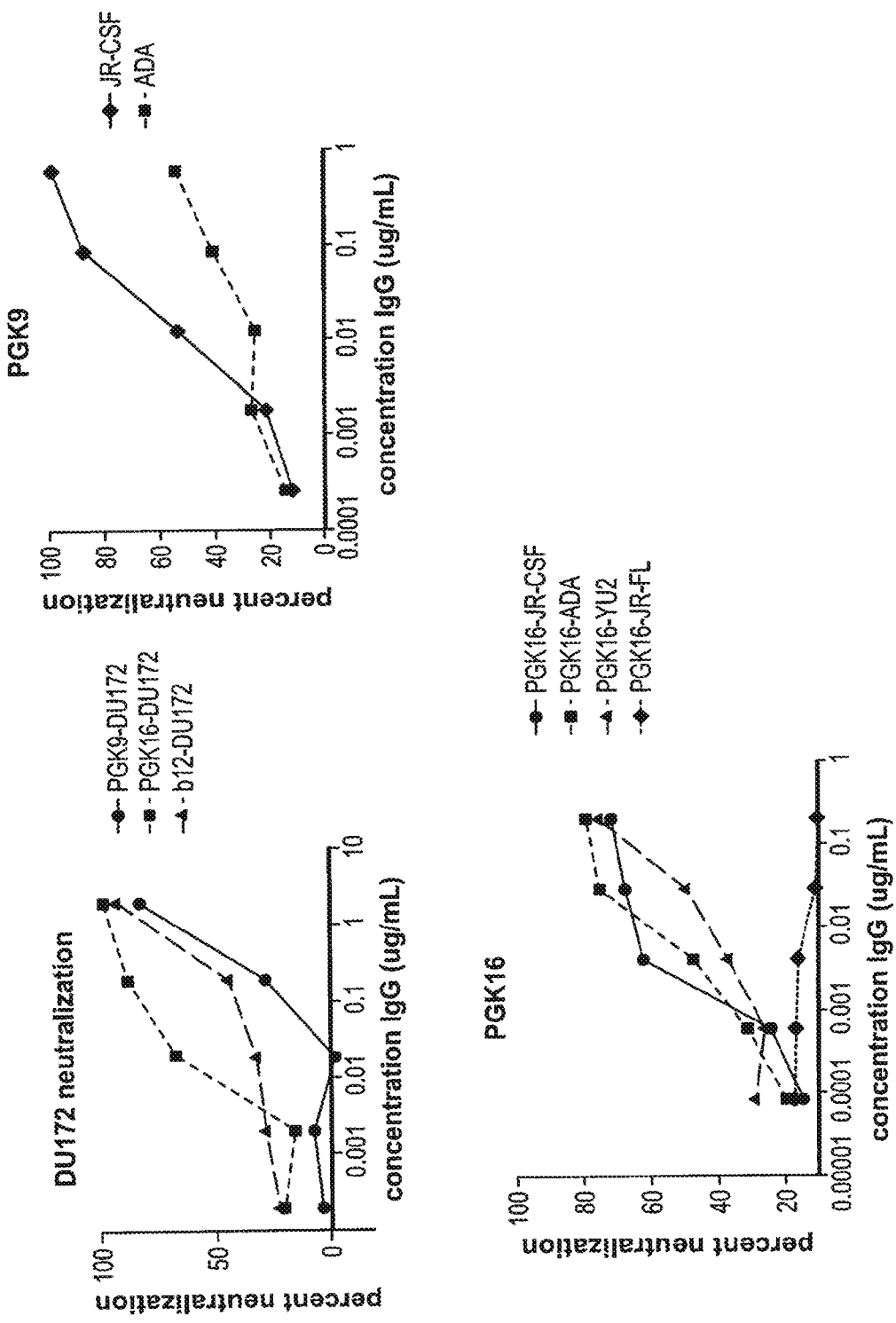
FIG. 4  PG9 and PG16 Neutralization Assays

FIG. 6 (continued)
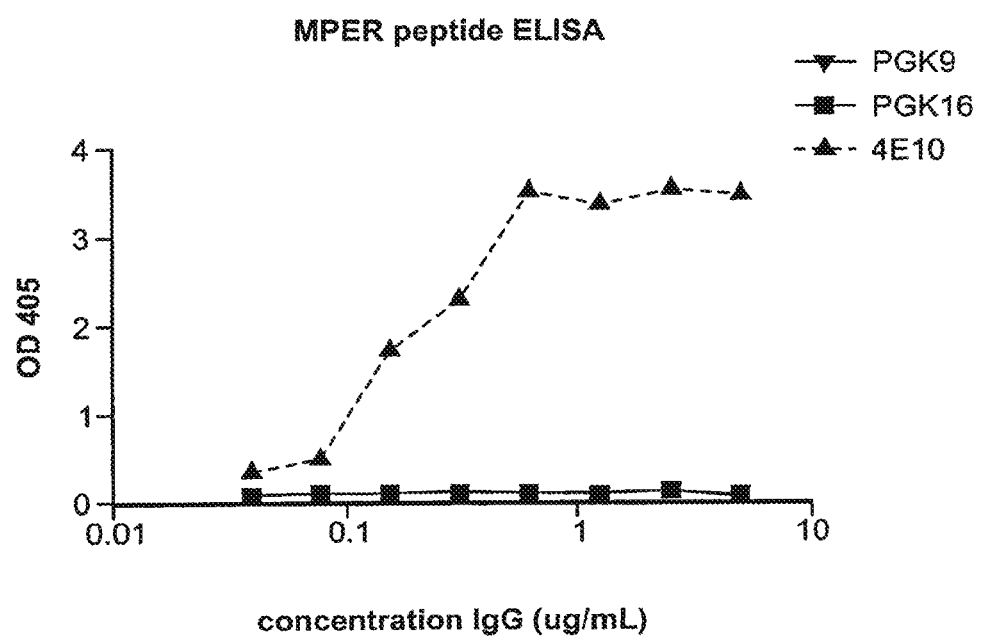
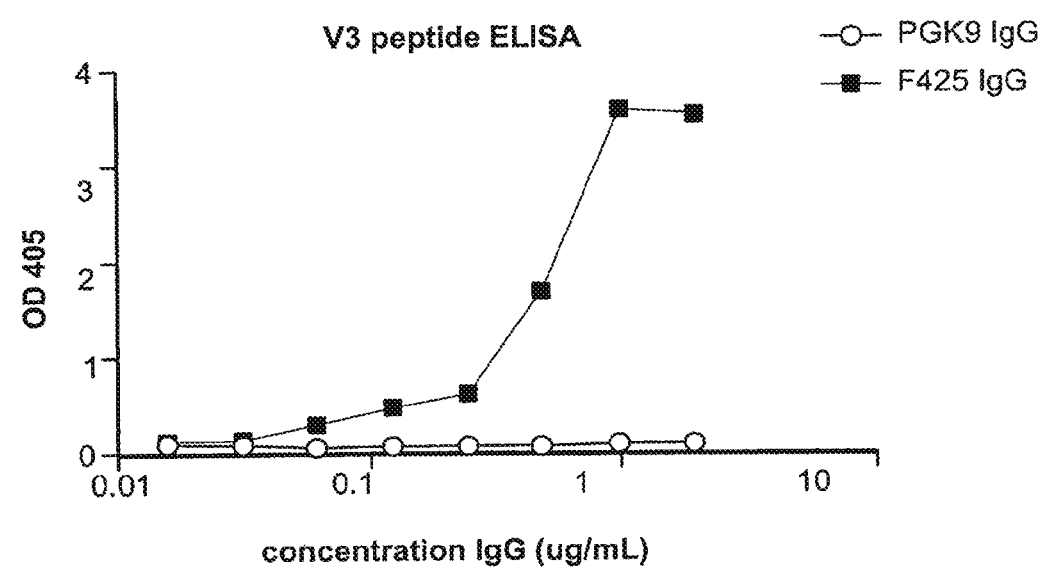

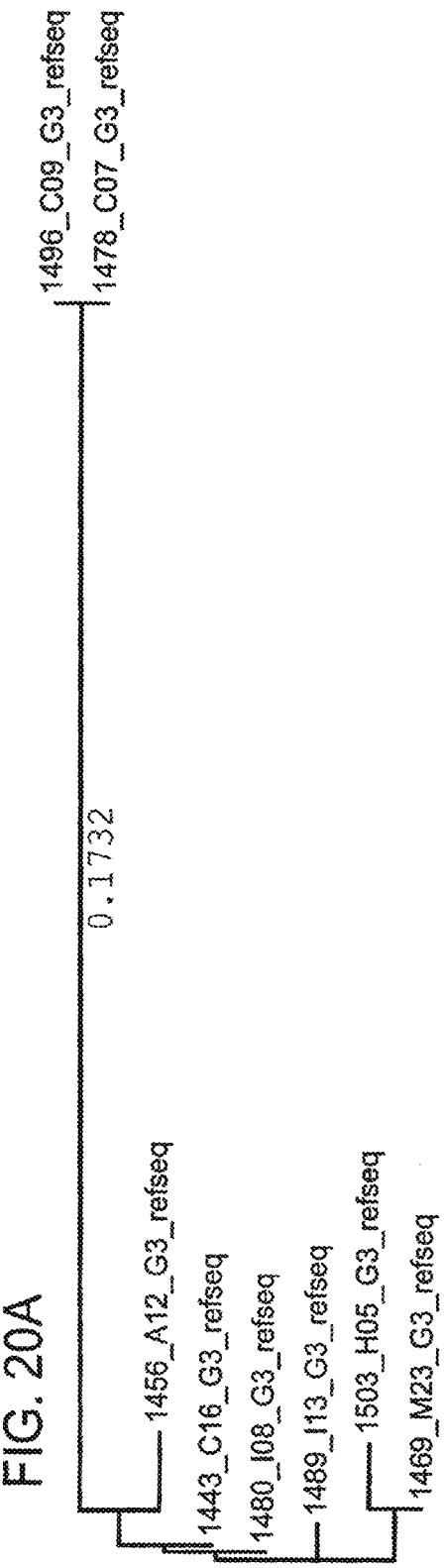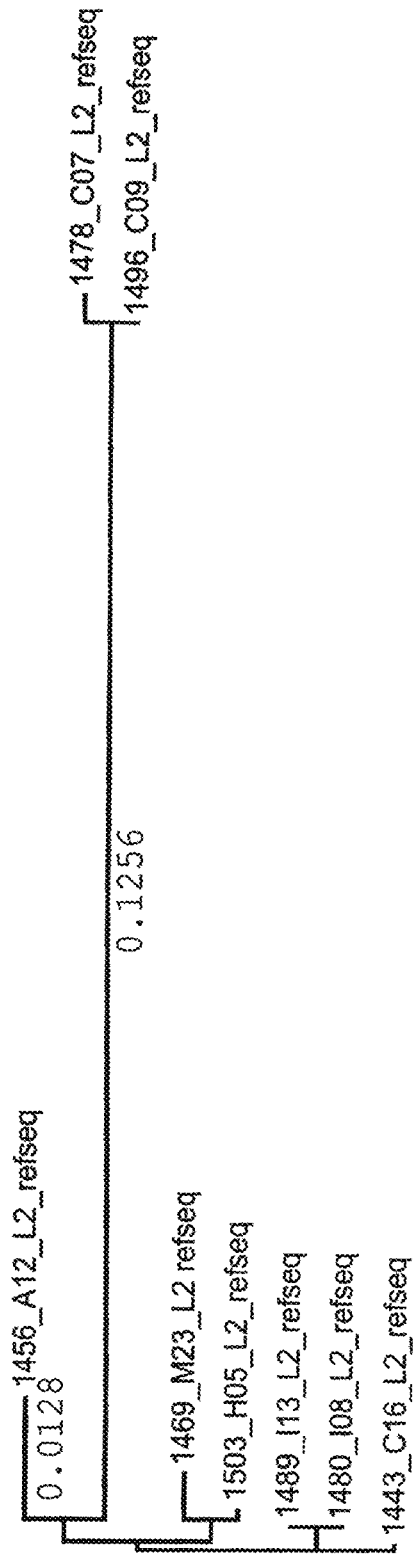

Heavy Chain Variable Gene Relationship Tree

Light Chain Variable Gene Relationship Tree

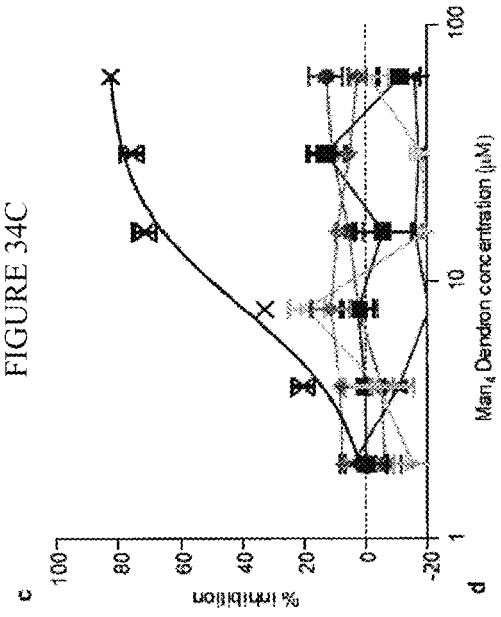
FIGURE 34C
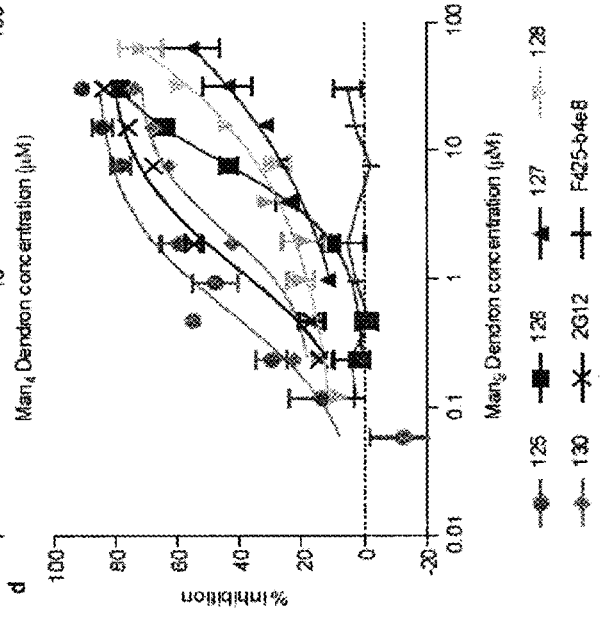
FIGURE 34D
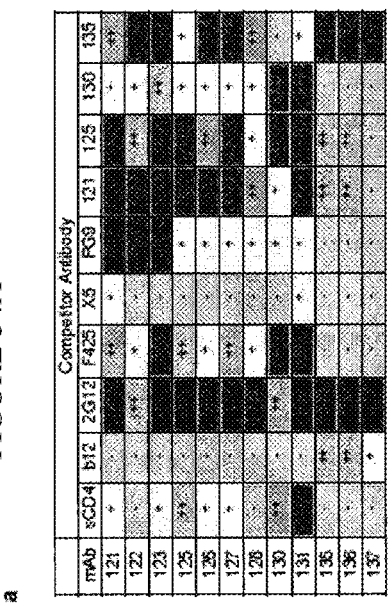
FIGURE 34A
FIGURE 34B

FIGURE 44A
FIGURE 44B
FIGURE 44C
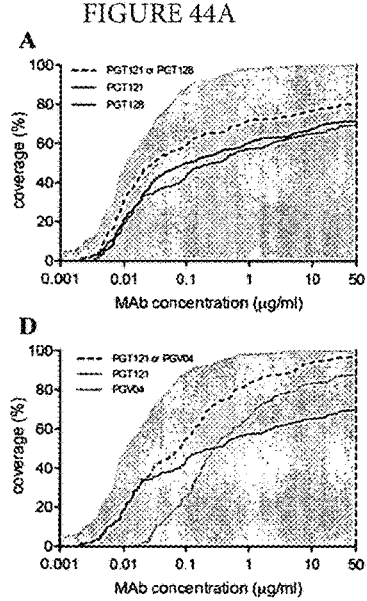
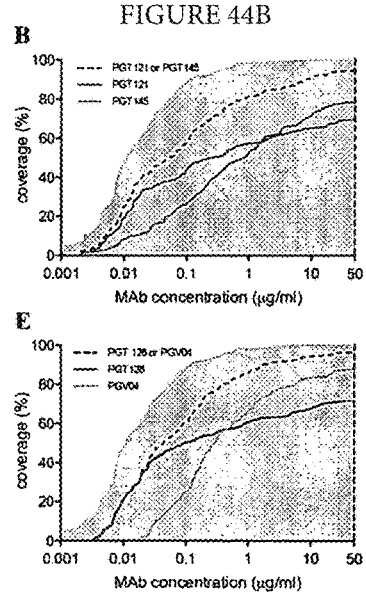
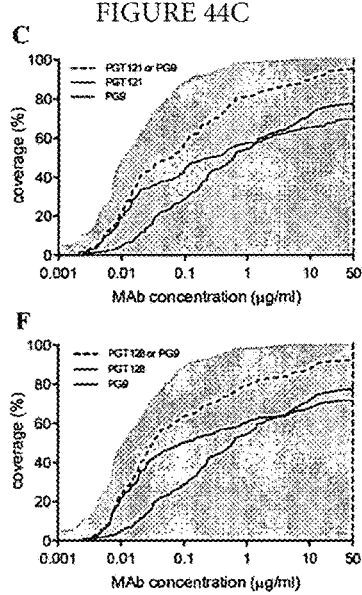
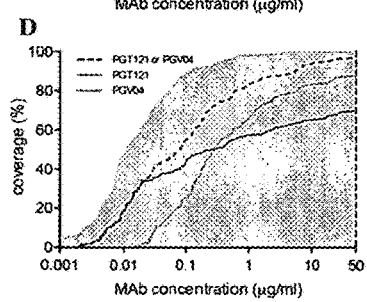
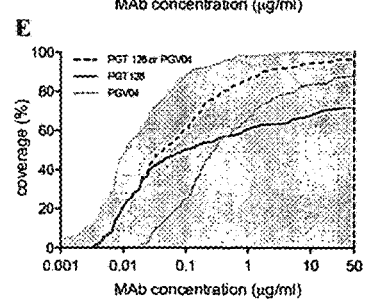
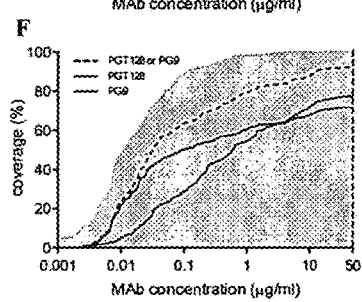
FIGURE 44D
FIGURE 44E
FIGURE 44F FIGURE 44G
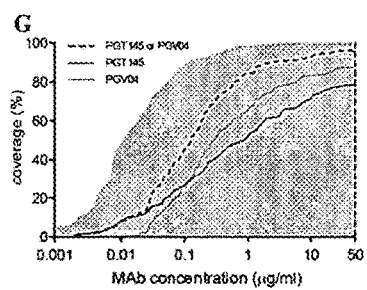
FIGURE 44H
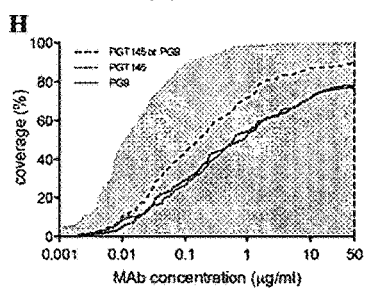
FIGURE 44I
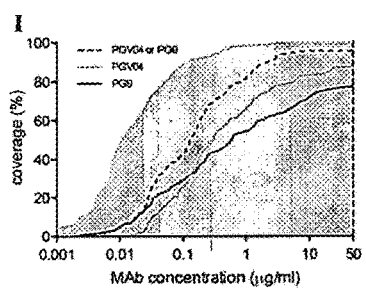
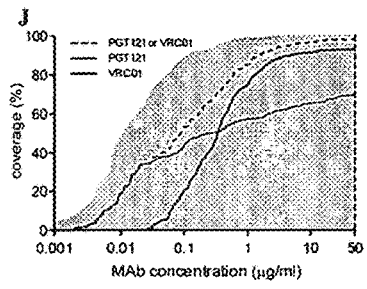
FIGURE 44J
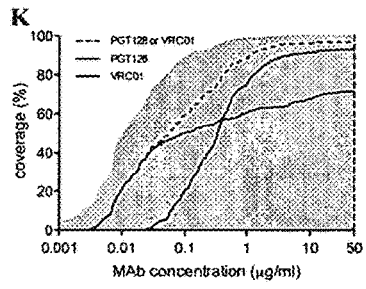
FIGURE 44K
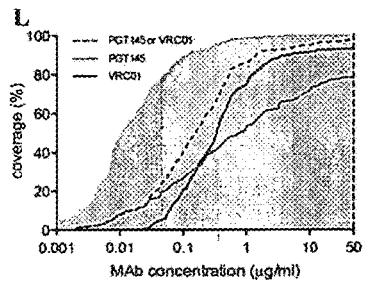
FIGURE 44L

FIGURE 45

Kabat CDR sequences for the PG16 sister clones are highlighted in boxes.

FIGURE 46

Kabat CDR sequences for the PG16 sister clones are highlighted in boxes.

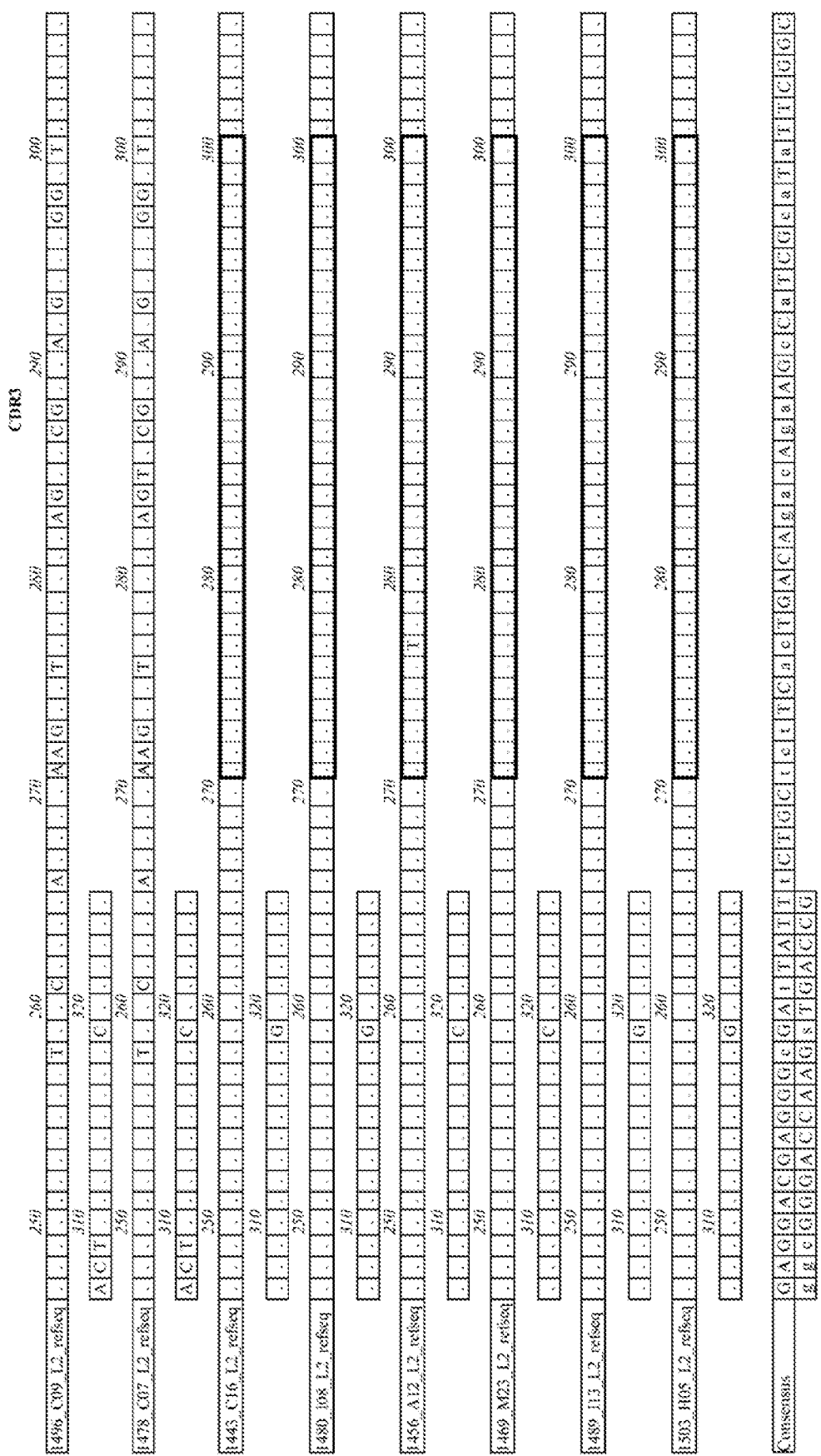

FIGURE 47

Kabat CDR sequences for the PG16 sister clones are highlighted in boxes.

FIGURE 48

Kabat CDR sequences for the PG16 sister clones are highlighted in black boxes.

Heavy Chain Variable Gene Alignment for PGT-121, PGT-122, PGT-123, PGT-125, PGT-126, PGT-130, PGT-135, and PGT-136.

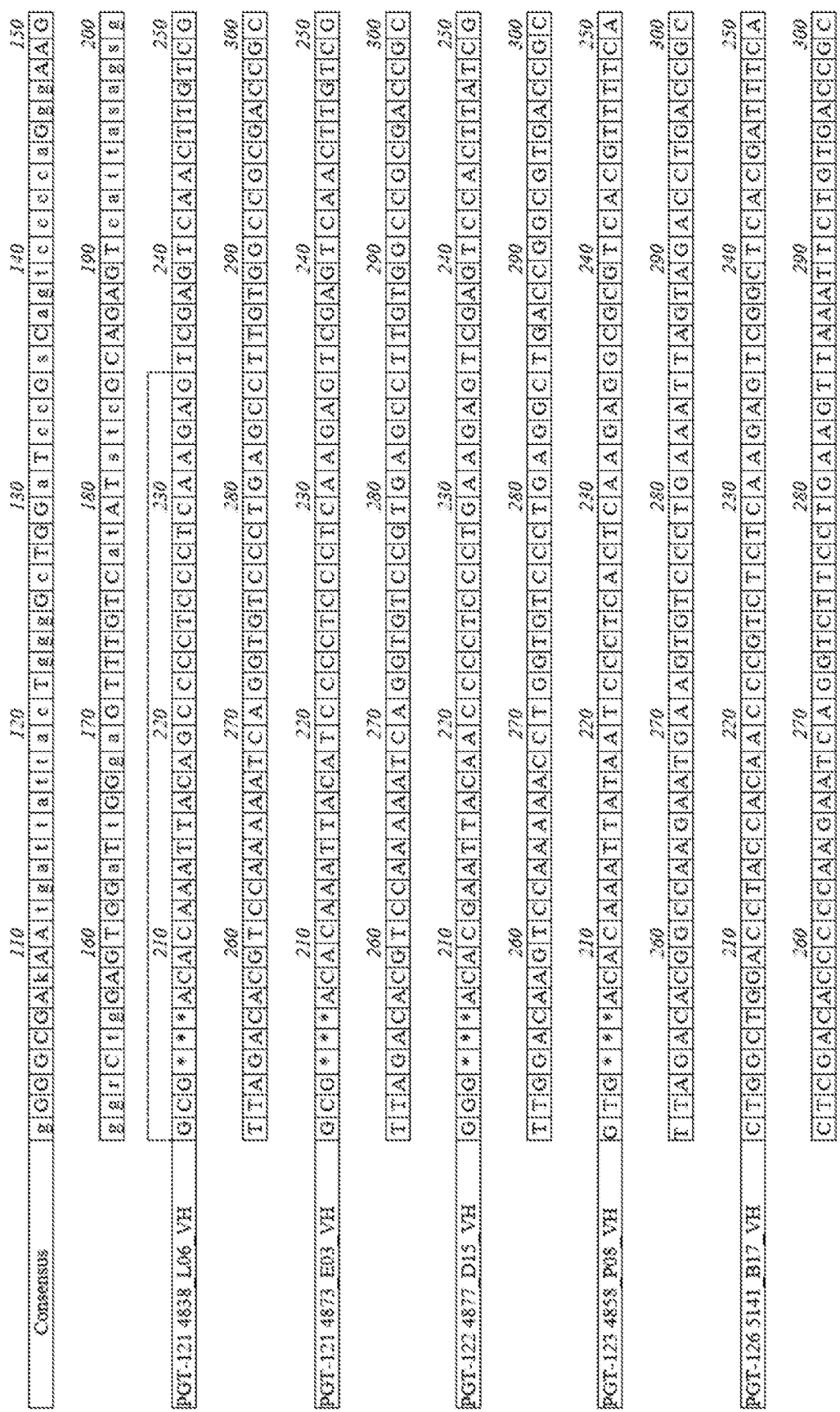

Heavy Chain Variable Protein Alignment for PGT-121, PGT-122, PGT-123, PGT-125, PGT-126, PGT-130, PGT-135, and PGT-136.

FIGURE 50 Cont'd

| | 10 | 20 | 30 | 40 | 50 |
|---|---|---|---|---|---|
| PGT-125 5123 A06 VH | QSQLQESGPRLVEASETLSLTCNVSGESTG | * | * | * | ACTYIFWGWVRQAPGK |

| | 60 | 70 | 80 | 90 | 100 |
|---|---|---|---|---|---|
| | GLEWIGSLISHCQSFWGSGWTFHNPSLKSRLTIISLDTPKMQVFLLKLTISLTIA |

| | 10 | 20 | 30 | 40 | 50 |
|---|---|---|---|---|---|
| PGT-130 5147 N06 VH | QVQLQESGPGLVKPIAETLSLTCSVSGEISIN | * | * | * | TIGHYIWGWVRQVPGK |

| | 60 | 70 | 80 | 90 | 100 |
|---|---|---|---|---|---|
| | GLEWIGHIHYITI | * | AVLHNPSLKSRLTIKIYTILRNQITLRLSNVITA |

| | 10 | 20 | 30 | 40 | 50 |
|---|---|---|---|---|---|
| PGT-135 5349 B08 VH | QLQMQESGPGLVKPSETLSLSCTVSGDSIRGGEWGDKDYHWGWVRHSAGK |

| | 60 | 70 | 80 | 90 | 100 |
|---|---|---|---|---|---|
| | GLEWIGSIHWRG | * | TTHYKESLRRRVSMSIDTSRNWFSLRLLASVITA |

| | 10 | 20 | 30 | 40 | 50 |
|---|---|---|---|---|---|
| PGT-135 5344 E16 VH | QLQMQESGPGLVKPSETLSLSCTVSGDSIRGGEWGDKDYHWGWVRHSAGK |

| | 60 | 70 | 80 | 90 | 100 |
|---|---|---|---|---|---|
| | GLEWIGSIHWRG | * | TTHYKESLRRRVSMSIDTSRNWFSLRLLASVITA |

| | 10 | 20 | 30 | 40 | 50 |
|---|---|---|---|---|---|
| PGT-136 5329 C19 VH | QLQLQESGPGLVKPSETLSLTCTVSQGSMRGTDWGENDFHYQWIRQSSAK |

| | 60 | 70 | 80 | 90 | 100 |
|---|---|---|---|---|---|
| | GLEWIGSIHWRGR | * | TTHYKTSFRSRATLSIDTSNNRFSLTFSFVITA |

| | 10 | 20 | 30 | 40 | 50 |
|---|---|---|---|---|---|
| PGT-136 5366 P1 VH | QLQLQESGPGLVKPSETLSLTCTVSGGSMRGTDWGENDFHYQWIRQSSAK |

| | 60 | 70 | 80 | 90 | 100 |
|---|---|---|---|---|---|
| | GLEWIGSIHWRGR | * | TTHYKTSFRSRATLSIDTSNNRFSLTFSFVITA |

FIGURE 51

Light Chain Variable Gene Alignment for PGT-121, PGT-122, PGT-123, PGT-125, PGT-126, PGT-130, PGT-135, and PGT-136.

Light Chain Variable Protein Alignment for PGT-121, PGT-122, PGT-123, PGT-125, PGT-126, PGT-130, PGT-135, and PGT-136.

FIGURE 52 Cont'd

| I | F | G | V | D | K | R | P | G | V | P | D | R | F | S | G | S | R | S | * | * | * | G | T | T | A | S | L | T | V | S | R | L | Q | T | D | D | E | A | V | Y | Y | C | G | S | L | V | G | N |
|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|---|

FIGURE 52 Cont'd

| | | 110 | |
|---|---|---|---|
| PGT-121 4838 L06 VL | V P T K W V | F G G | G T T L T V L |
| PGT-121 4873 E03 VL | V P T K W V | F G G | G T T L T V L |
| PGT-122 4877 D15 VL | R P T N W V | F G E | G T T L T V L |
| PGT-123 4858 P08 VL | G G T N W V | F G G | G T T L T V L |
| PGT-126 5141 B17 VL | * * W D V | F | D R G T T L T V L |
| PGT-125 5123 A06 VL | * * W D V | V F G G | G T K L T V L |
| PGT-130 5147 N06 VL | * * W D V | V F G G | G T K L T V L |
| PGT-135 5343 B08 VL | P * * R T | F G Q | G T K V D I K |
| PGT-135 5344 E16 VL | P * * R T | F G Q | G T K V D I K |
| PGT-136 5329 C19 VL | P * * R T | F G Q | G T K V D I K |
| PGT-136 5366 P21 VL | P * * R T | F G Q | G T K Y D I K |
| Consensus | X p t X X X | F g X | G T i k l t v l |

Heavy Chain Variable Gene Alignment for PGT-141, PGT-142, PGT-143, and PGT-144.

Heavy Chain Variable Protein Alignment for PGT-141, PGT-142, PGT-143, and PGT-144.

FIGURE 54 Cont'd

| | | | | | | | | | | | | | | | 139 | | | | | | | | | | 140 | |
|---|---|---|---|---|---|---|---|---|---|---|---|---|---|---|---|---|---|---|---|---|---|---|---|---|---|---|
| PGT-141 | Translation of 4864_G22_G1 refseq | W | N | D | Y | L | E | F | L | D | V | W | G | H | G | T | A | V | T | V | S | S |
| PGT-141 | Translation of 4893_K13_G1 refseq | W | N | D | Y | L | E | F | L | D | V | W | G | H | G | T | A | V | I | V | S | S |
| PGT-142 | Translation of 4895_E20_G1 refseq | W | N | D | Y | L | E | F | L | D | V | W | G | H | G | T | A | V | I | V | S | S |
| PGT-143 | Translation of 4980_M08_G1 refseq | W | N | D | Y | L | E | F | L | D | V | W | G | H | G | T | A | V | T | V | S | S |
| PGT-144 | Translation of 4979_K22_G1 refseq | W | N | D | Y | L | E | F | L | D | V | W | G | H | G | T | A | V | T | V | S | S |
| | Consensus | W | N | D | Y | L | E | F | L | D | V | W | G | H | G | T | A | V | T | V | S | S |

Light Chain Variable Gene Alignment for PGT-141, PGT 142, PGT-143, and PGT-144

BROADLY NEUTRALIZING HUMAN IMMUNODEFICIENCY VIRUS TYPE 1 (HIV-1) GP120-SPECIFIC MONOCLONAL ANTIBODY

RELATED APPLICATIONS AND INCORPORATION BY REFERENCE

This application is a continuation of U.S. application Ser. No. 15/152,630 filed May 12, 2016, now pending, which is a continuation of U.S. application Ser. No. 13/780,776 filed Feb. 28, 2013, now U.S. Pat. No. 9,464,131, which issued on Oct. 11, 2016, which is a continuation-in-part application of international patent application Serial No. PCT/US2011/049880 filed Aug. 31, 2011, which published as PCT Publication No. WO 2012/030904 on Mar. 8, 2012, which claims priority to U.S. Provisional Patent Application Ser. Nos. 61/378,604 filed Aug. 31, 2010, 61/386,940 filed Sep. 27, 2010, 61/476,978 filed Apr. 19, 2011 and 61/515,548 filed Aug. 5, 2011.

The foregoing applications, and all documents cited therein or during their prosecution ("appin cited documents") and all documents cited or referenced in the appin cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

GOVERNMENT SUPPORT

This invention was made with Government support under Grant Nos. AI033292 and AI084817 awarded by the National Institutes of Health. This invention was also made in part with Government Support under Grant No. GPH G 00 06 00006 00 awarded by the U.S. Agency for International Development ("USAID"). The Government has certain rights in the invention.

SEQUENCE STATEMENT

The instant application contains a Sequence Listing which has been submitted electronically in ASCII format and is hereby incorporated by reference in its entirety. Said ASCII copy, named 15701679.txt and is 6'15 661,108 bytes in size.

FIELD OF THE INVENTION

The present invention relates generally to therapy, diagnosis and monitoring of human immunodeficiency virus (HIV) infection. The invention is more specifically related to human neutralizing monoclonal antibodies specific for HIV-1, such as broad and potent neutralizing monoclonal antibodies specific for HIV-1 and their manufacture and use. Broad neutralization suggests that the antibodies can neutralize HIV-1 isolates from different individuals. Such antibodies are useful in pharmaceutical compositions for the prevention and treatment of HIV, and for the diagnosis and monitoring of HIV infection and for design of HIV vaccine immunogens.

BACKGROUND OF THE INVENTION

AIDS was first reported in the United States in 1981 and has since become a major worldwide epidemic. AIDS is caused by the human immunodeficiency virus, or HIV. By killing or damaging cells of the body's immune system, HIV progressively destroys the body's ability to fight infections and certain cancers. People diagnosed with AIDS may get life-threatening diseases called opportunistic infections. These infections are caused by microbes such as viruses or bacteria that usually do not make healthy people sick. HIV is spread most often through unprotected sex with an infected partner. HIV also is spread through contact with infected blood. The human immunodeficiency virus (HIV) is the cause of acquired immune deficiency syndrome (AIDS) (Barre-Sinoussi, F., et al., 1983, Science 220:868-870; Gallo, R., et al., 1984, Science 224:500-503). There are currently 1.25 million people in the US infected with HIV-induced acquired immunodeficiency syndrome according to a Center for Disease Control report. The epidemic is growing most rapidly among minority populations and is a leading killer of African-American males ages 25 to 44. According, AIDS affects nearly seven times more African Americans and three times more Hispanics than whites. In recent years, an increasing number of African-American women and children are being affected by HIV/AIDS. With over 40 million people infected worldwide, the current global HIV pandemic ranks among the greatest infectious disease scourges in human history.

There is therefore a need for the efficient identification and production of neutralizing antibodies effective against multiple clades and strains of HIV as well as the elucidation of the target and antigenic determinants to which such antibodies bind.

Citation or identification of any document in this application is not an admission that such document is available as prior art to the present invention.

SUMMARY OF THE INVENTION

The present invention provides a novel method for isolating potent, broadly neutralizing monoclonal antibodies against HIV. Peripheral Blood Mononuclear Cells (PBMCs) are obtained from an HIV-infected donor selected for HIV-1 neutralizing activity in the plasma, and memory B cells are isolated for culture in vitro. The B cell culture supernatants may then be screened by a primary neutralization assay in a high throughput format, and B cell cultures exhibiting neutralizing activity may be selected for rescue of monoclonal antibodies. It is surprisingly observed that neutralizing antibodies obtained by this method do not always exhibit gp120 or gp41 binding at levels that correlate with neutralization activity. The method of the invention therefore allows identification of novel antibodies with cross-clade neutralization properties.

The present invention provides human monoclonal antibodies specifically directed against HIV. In certain embodiments, the invention provides human anti-HIV monoclonal antibodies including, but not limited to, 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06

(PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158) and sister clones thereof. For instance, an exemplary sister clone of the 1443_C16 (PG16) (TCN-116) antibody is the 1503 H05 (PG16) (TCN-119) antibody, the 1456 A12 (PG16) (TCN-117) antibody, the 1469 M23 (PG16) (TCN-118) antibody, the 1489_I13 (PG16) (TCN-120) antibody, or the 1480_I08 (PG16) antibody.

Specifically, the invention provides an isolated anti-HIV antibody, wherein said antibody may have heavy chain with three CDRs which may comprise an amino acid sequence selected from the group consisting of the amino acid sequences of KYGMH (SEQ ID NO: 88), LISDDGMRKYHSDSMWG (SEQ ID NO: 89), and EAGGPIWHDDVKYYDFNDGYYNYHYMDV (SEQ ID NO: 6), and a light chain with three CDRs that include an amino acid sequence selected from the group consisting of the amino acid sequences of NGTSSDVGGFDSVS (SEQ ID NO: 97), DVSHRPS (SEQ ID NO: 95), and SSLTDRSHRI (SEQ ID NO: 41).

The invention provides an isolated anti-HIV antibody, wherein said antibody may have a heavy chain with three CDRs which may comprise an amino acid sequence selected from the group consisting of the amino acid sequences of GFTFHK (SEQ ID NO: 266), LISDDGMRKY (SEQ ID NO: 267), and EAGGPIWHDDVKYYDFNDGYYNYHYMDV (SEQ ID NO: 6), and a light chain with three CDRs that include an amino acid sequence selected from the group consisting of the amino acid sequences of NGTSSDVGGFDSVS (SEQ ID NO: 97), DVSHRPS (SEQ ID NO: 95), and SSLTDRSHRI (SEQ ID NO: 41).

The invention provides an isolated anti-HIV antibody, wherein said antibody may have a heavy chain with three CDRs which may comprise an amino acid sequence selected from the group consisting of the amino acid sequences of KYGMH (SEQ ID NO: 88), LISDDGMRKYHSDSMWG (SEQ ID NO: 89), and EAGGPIWHDDVKYYDFNDGYYNYHYMDV (SEQ ID NO: 6), and a light chain with three CDRs that include an amino acid sequence selected from the group consisting of the amino acid sequences of NGTRSDVGGFDSVS (SEQ ID NO: 92), DVSHRPS (SEQ ID NO: 95), and SSLTDRSHRI (SEQ ID NO: 41).

The invention provides an isolated anti-HIV antibody, wherein said antibody may have a heavy chain with three CDRs which may comprise an amino acid sequence selected from the group consisting of the amino acid sequences of GFTFHK (SEQ ID NO: 266), LISDDGMRKY (SEQ ID NO: 267), and EAGGPIWHDDVKYYDFNDGYYNYHYMDV (SEQ ID NO: 6), and a light chain with three CDRs that include an amino acid sequence selected from the group consisting of the amino acid sequences of NGTRSDVGGFDSVS (SEQ ID NO: 92), DVSHRPS (SEQ ID NO: 95), and SSLTDRSHRI (SEQ ID NO: 41).

The invention provides an isolated anti-HIV antibody, wherein said antibody may have a heavy chain with three CDRs which may comprise an amino acid sequence selected from the group consisting of the amino acid sequences of KYGMH (SEQ ID NO: 88), LISDDGMRKYHSDSMWG (SEQ ID NO: 89), and EAGGPIWHDDVKYYDFNDGYYNYHYMDV (SEQ ID NO: 6), and a light chain with three CDRs that include an amino acid sequence selected from the group consisting of the amino acid sequences of NGTSRDVGGFDSVS (SEQ ID NO: 93), DVSHRPS (SEQ ID NO: 95), and SSLTDRSHRI (SEQ ID NO: 41).

The invention provides an isolated anti-HIV antibody, wherein said antibody may have a heavy chain with three CDRs which may comprise an amino acid sequence selected from the group consisting of the amino acid sequences of GFTFHK (SEQ ID NO: 266), LISDDGMRKY (SEQ ID NO: 267), and EAGGPIWHDDVKYYDFNDGYYNYHYMDV (SEQ ID NO: 6), and a light chain with three CDRs that include an amino acid sequence selected from the group consisting of the amino acid sequences of NGTSRDVGGFDSVS (SEQ ID NO: 93), DVSHRPS (SEQ ID NO: 95), and SSLTDRSHRI (SEQ ID NO: 41).

The invention provides an isolated anti-HIV antibody, wherein said antibody may have a heavy chain with three CDRs cwhich may comprise an amino acid sequence selected from the group consisting of the amino acid sequences of KYGMH (SEQ ID NO: 88), LISDDGMRKYHSNSMWG (SEQ ID NO: 98), and EAGGPIWHDDVKYYDFNDGYYNYHYMDV (SEQ ID NO: 6), and a light chain with three CDRs that include an amino acid sequence selected from the group consisting of the amino acid sequences of NGTSSDVGGFDSVS (SEQ ID NO: 97), DVSHRPS (SEQ ID NO: 95), and SSLTDRSHRI (SEQ ID NO: 41).

The invention provides an isolated anti-HIV antibody, wherein said antibody may have a heavy chain with three CDRs which may comprise an amino acid sequence selected from the group consisting of the amino acid sequences of SYAFT (SEQ ID NO: 104), MVTPIFGEAKYSQRFEG (SEQ ID NO: 105), and DRRAVPIATDNWLDP (SEQ ID NO: 9), and a light chain with three CDRs that include an amino acid sequence selected from the group consisting of the amino acid sequences of RASQTINNYLN (SEQ ID NO: 107), GASNLQN (SEQ ID NO: 108), and QQSFSTPRT (SEQ ID NO: 42).

The invention provides an isolated anti-HIV antibody, wherein said antibody may have a heavy chain with three CDRs which may comprise an amino acid sequence selected from the group consisting of the amino acid sequences of GGTFSS (SEQ ID NO: 268), MVTPIFGEAK (SEQ ID NO: 269), and DRRAVPIATDNWLDP (SEQ ID NO: 9), and a light chain with three CDRs that include an amino acid sequence selected from the group consisting of the amino acid sequences of RASQTINNYLN (SEQ ID NO: 107), GASNLQN (SEQ ID NO: 108), and QQSFSTPRT (SEQ ID NO: 42).

The invention provides an isolated anti-HIV antibody, wherein said antibody may have a heavy chain with three CDRs which may comprise an amino acid sequence selected from the group consisting of the amino acid sequences of SYAFS (SEQ ID NO: 110), MITPVFGETKYAPRFQG (SEQ ID NO: 111), and DRRVVPMATDNWLDP (SEQ ID NO: 8), and a light chain with three CDRs that include an amino acid sequence selected from the group consisting of the amino acid sequences of RASQTIHTYLN (SEQ ID NO: 113), GASTLQS (SEQ ID NO: 114), and QQSYSTPRT (SEQ ID NO: 43).

The invention provides an isolated anti-HIV antibody, wherein said antibody may have a heavy chain with three CDRs which may comprise an amino acid sequence selected from the group consisting of the amino acid sequences of GGAFSS (SEQ ID NO: 270), MITPVFGETK (SEQ ID NO: 271), DRRVVPMATDNWLDP (SEQ ID NO: 8), and a light chain with three CDRs that include an amino acid sequence selected from the group consisting of the amino acid sequences of RASQTIHTYLN (SEQ ID NO: 113), GASTLQS (SEQ ID NO: 114), and QQSYSTPRT (SEQ ID NO: 43).

The invention provides an isolated anti-HIV antibody, wherein said antibody may have a heavy chain with three CDRs which may comprise an amino acid sequence selected from the group consisting of the amino acid sequences of DYYLH (SEQ ID NO: 116), LIDPENGEARYAEKFQG (SEQ ID NO: 117), GAVGADSGSWFDP (SEQ ID NO: 10), and a light chain with three CDRs that include an amino acid sequence selected from the group consisting of the amino acid sequences of SGSKLGDKYVS (SEQ ID NO: 120), ENDRRPS (SEQ ID NO: 121), QAWETTTTFVF (SEQ ID NO: 44).

The invention provides an isolated anti-HIV antibody, wherein said antibody may have a heavy chain with three CDRs which may comprise an amino acid sequence selected from the group consisting of the amino acid sequences of GYSFID (SEQ ID NO: 102), LIDPENGEAR (SEQ ID NO: 103), GAVGADSGSWFDP (SEQ ID NO: 10), and a light chain with three CDRs that include an amino acid sequence selected from the group consisting of the amino acid sequences of SGSKLGDKYVS (SEQ ID NO: 120), ENDRRPS (SEQ ID NO: 121), QAWETTTTFVF (SEQ ID NO: 44).

The invention provides an isolated anti-HIV antibody, wherein said antibody may have a heavy chain with three CDRs which may comprise an amino acid sequence selected from the group consisting of the amino acid sequences of RQGMH (SEQ ID NO: 123), FIKYDGSEKYHADSVWG (SEQ ID NO: 124), and EAGGPDYRNGYNYYDFYDGYYNYHYMDV (SEQ ID NO: 7), and a light chain with three CDRs that include an amino acid sequence selected from the group consisting of the amino acid sequences of NGTSNDVGGYESVS (SEQ ID NO: 126), DVSKRPS (SEQ ID NO: 127), and KSLTSTRRRV (SEQ ID NO: 45).

The invention provides an isolated anti-HIV antibody, wherein said antibody may have a heavy chain with three CDRs which may comprise an amino acid sequence selected from the group consisting of the amino acid sequences of GFDFSR (SEQ ID NO: 118), FIKYDGSEKY (SEQ ID NO: 272), and EAGGPDYRNGYNYYDFYDGYYNYHYMDV (SEQ ID NO: 7), and a light chain with three CDRs that include an amino acid sequence selected from the group consisting of the amino acid sequences of NGTSNDVGGYESVS (SEQ ID NO: 126), DVSKRPS (SEQ ID NO: 127), and KSLTSTRRRV (SEQ ID NO: 45).

The invention provides an isolated anti-HIV antibody, wherein said antibody may have a heavy chain with three CDRs including an amino acid sequence selected from the group consisting of the amino acid sequences of DSYWS (SEQ ID NO: 90), YVHKSGDTNYSPSLKS (SEQ ID NO: 265), TLHGRRIYGIVAFNEWFTYFYMDV (SEQ ID NO: 143), and a light chain with three CDRs that include an amino acid sequence selected from the group consisting of the amino acid sequences of GEKSLGSRAVQ (SEQ ID NO: 150), NNQDRPS (SEQ ID NO: 151), HIWDSRVPTKWV (SEQ ID NO: 152).

The invention provides an isolated anti-HIV antibody, wherein said antibody may have a heavy chain with three CDRs including an amino acid sequence selected from the group consisting of the amino acid sequences of GASISD (SEQ ID NO: 144), YVHKSGDTN (SEQ ID NO: 145), TLHGRRIYGIVAFNEWFTYFYMDV (SEQ ID NO: 143), and a light chain with three CDRs that include an amino acid sequence selected from the group consisting of the amino acid sequences of GEKSLGSRAVQ (SEQ ID NO: 150), NNQDRPS (SEQ ID NO: 151), HIWDSRVPTKWV (SEQ ID NO: 152).

The invention provides an isolated anti-HIV antibody, wherein said antibody may have a heavy chain with three CDRs including an amino acid sequence selected from the group consisting of the amino acid sequences of DNYWS (SEQ ID NO: 261), YVHDSGDTNYNPSLKS (SEQ ID NO: 157), and TKHGRRIYGVVAFKEWFTYFYMDV (SEQ ID NO: 262), and a light chain with three CDRs that include an amino acid sequence selected from the group consisting of the amino acid sequences of GEESLGSRSVI (SEQ ID NO: 162), NNNDRPS (SEQ ID NO: 163), and HIWDSRRPTNWV (SEQ ID NO: 164).

The invention provides an isolated anti-HIV antibody, wherein said antibody may have a heavy chain with three CDRs including an amino acid sequence selected from the group consisting of the amino acid sequences of GTLVRD (SEQ ID NO: 263), YVHDSGDTN (SEQ ID NO: 264), and TKHGRRIYGVVAFKEWFTYFYMDV (SEQ ID NO: 262), and a light chain with three CDRs that include an amino acid sequence selected from the group consisting of the amino acid sequences of GEESLGSRSVI (SEQ ID NO: 162), NNNDRPS (SEQ ID NO: 163), and HIWDSRRPTNWV (SEQ ID NO: 164).

The invention provides an isolated anti-HIV antibody, wherein said antibody may have a heavy chain with three CDRs including an amino acid sequence selected from the group consisting of the amino acid sequences of DAYWS (SEQ ID NO: 169), YVHHSGDTNYNPSLKR (SEQ ID NO: 170), and ALHGKRIYGIVALGELFTYFYMDV (SEQ ID NO: 171), and a light chain with three CDRs that include an amino acid sequence selected from the group consisting of the amino acid sequences of GKESIGSRAVQ (SEQ ID NO: 178), NNQDRPA (SEQ ID NO: 179), and HIYDARGGTNWV (SEQ ID NO: 180).

The invention provides an isolated anti-HIV antibody, wherein said antibody may have a heavy chain with three CDRs including an amino acid sequence selected from the group consisting of the amino acid sequences of GASIND (SEQ ID NO: 172), YVHHSGDTN (SEQ ID NO: 173), and ALHGKRIYGIVALGELFTYFYMDV (SEQ ID NO: 171), and a light chain with three CDRs that include an amino acid sequence selected from the group consisting of the amino acid sequences of GKESIGSRAVQ (SEQ ID NO: 178), NNQDRPA (SEQ ID NO: 179), and HIYDARGGTNWV (SEQ ID NO: 180).

The invention provides an isolated anti-HIV antibody, wherein said antibody may have a heavy chain with three CDRs including an amino acid sequence selected from the group consisting of the amino acid sequences of ACTYFWG (SEQ ID NO: 185), SLSHCQSFWGSGWTFHNPSLKS (SEQ ID NO: 186), and FDGEVLVYNHWPKPAWVDL (SEQ ID NO: 187), and a light chain with three CDRs that include an amino acid sequence selected from the group consisting of the amino acid sequences of NGTATNFVS (SEQ ID NO: 194), GVDKRPP (SEQ ID NO: 195), and GSLVGNWDVI (SEQ ID NO: 196).

The invention provides an isolated anti-HIV antibody, wherein said antibody may have a heavy chain with three CDRs including an amino acid sequence selected from the group consisting of the amino acid sequences of GESTGACT (SEQ ID NO: 188), SLSHCQSFWGSGWTF (SEQ ID NO: 189), and FDGEVLVYNHWPKPAWVDL (SEQ ID NO: 187), and a light chain with three CDRs that include an amino acid sequence selected from the group consisting of the amino acid sequences of NGTATNFVS (SEQ ID NO: 194), GVDKRPP (SEQ ID NO: 195), and GSLVGNWDVI (SEQ ID NO: 196).

The invention provides an isolated anti-HIV antibody, wherein said antibody may have a heavy chain with three CDRs including an amino acid sequence selected from the group consisting of the amino acid sequences of ACDYFWG (SEQ ID NO: 201), GLSHCAGYYNTGWTYHNPSLKS (SEQ ID NO: 202), and FDGEVLVYHDWPKPAWVDL (SEQ ID NO: 203), and a light chain with three CDRs that include an amino acid sequence selected from the group consisting of the amino acid sequences of TGTSNRFVS (SEQ ID NO: 210), GVNKRPS (SEQ ID NO: 211), and SSLVGNWDVI (SEQ ID NO: 212).

The invention provides an isolated anti-HIV antibody, wherein said antibody may have a heavy chain with three CDRs including an amino acid sequence selected from the group consisting of the amino acid sequences of GDSTAACD (SEQ ID NO: 204), GLSHCAGYYNTGWTY (SEQ ID NO: 205), and FDGEVLVYHDWPKPAWVDL (SEQ ID NO: 203), and a light chain with three CDRs that include an amino acid sequence selected from the group consisting of the amino acid sequences of TGTSNRFVS (SEQ ID NO: 210), GVNKRPS (SEQ ID NO: 211), and SSLVGNWDVI (SEQ ID NO: 212).

The invention provides an isolated anti-HIV antibody, wherein said antibody may have a heavy chain with three CDRs including an amino acid sequence selected from the group consisting of the amino acid sequences of TGHYYWG (SEQ ID NO: 217), HIHYTTAVLHNPSLKS (SEQ ID NO: 218), and SGGDILYYYEWQKPHWFSP (SEQ ID NO: 219), and a light chain with three CDRs that include an amino acid sequence selected from the group consisting of the amino acid sequences of NGTSSDIGGWNFVS (SEQ ID NO: 226), EVNKRPS (SEQ ID NO: 227), and SSLFGRWDVV (SEQ ID NO: 228).

The invention provides an isolated anti-HIV antibody, wherein said antibody may have a heavy chain with three CDRs including an amino acid sequence selected from the group consisting of the amino acid sequences of GESINTGH (SEQ ID NO: 220), HIHYTTAVL (SEQ ID NO: 221), and SGGDILYYYEWQKPHWFSP (SEQ ID NO: 219), and a light chain with three CDRs that include an amino acid sequence selected from the group consisting of the amino acid sequences of NGTSSDIGGWNFVS (SEQ ID NO: 226), EVNKRPS (SEQ ID NO: 227), and SSLFGRWDVV (SEQ ID NO: 228).

The invention provides an isolated anti-HIV antibody, wherein said antibody may have a heavy chain with three CDRs including an amino acid sequence selected from the group consisting of the amino acid sequences of GGEWGDKDYHWG (SEQ ID NO: 233), SIHWRGTTHYKESLRR (SEQ ID NO: 234), and HRHHDVFMLVPIAGWFDV (SEQ ID NO: 235), and a light chain with three CDRs that include an amino acid sequence selected from the group consisting of the amino acid sequences of RASQNINKNLA (SEQ ID NO: 243), ETYSKIA (SEQ ID NO: 244), and QQYEEWPRT (SEQ ID NO: 245).

The invention provides an isolated anti-HIV antibody, wherein said antibody may have a heavy chain with three CDRs including an amino acid sequence selected from the group consisting of the amino acid sequences of GDSIRGGEWGDKD (SEQ ID NO: 236), SIHWRGTTH (SEQ ID NO: 237), and HRHHDVFMLVPIAGWFDV (SEQ ID NO: 235), and a light chain with three CDRs that include an amino acid sequence selected from the group consisting of the amino acid sequences of RASQNINKNLA (SEQ ID NO: 243), ETYSKIA (SEQ ID NO: 244), and QQYEEWPRT (SEQ ID NO: 245).

The invention provides an isolated anti-HIV antibody, wherein said antibody may have a heavy chain with three CDRs including an amino acid sequence selected from the group consisting of the amino acid sequences of GTDWGENDFHYG (SEQ ID NO: 250), SIHWRGRTTHYKTSFRS (SEQ ID NO: 251), HKYHDIFRVVPVAGWFDP (SEQ ID NO: 252), and a light chain with three CDRs that include an amino acid sequence selected from the group consisting of the amino acid sequences of RASQNVKNNLA (SEQ ID NO: 259), DASSRAG (SEQ ID NO: 260), QQYEEWPRT (SEQ ID NO: 245).

The invention provides an isolated anti-HIV antibody, wherein said antibody may have a heavy chain with three CDRs including an amino acid sequence selected from the group consisting of the amino acid sequences of GGSMRGTDWGEND (SEQ ID NO: 253), SIHWRGRTTH (SEQ ID NO: 254), HKYHDIFRVVPVAGWFDP (SEQ ID NO: 252), and a light chain with three CDRs that include an amino acid sequence selected from the group consisting of the amino acid sequences of RASQNVKNNLA (SEQ ID NO: 259), DASSRAG (SEQ ID NO: 260), QQYEEWPRT (SEQ ID NO: 245).

The invention provides an isolated anti-HIV antibody, wherein said antibody may have a heavy chain with three CDRs which may comprise an amino acid sequence selected from the group consisting of the amino acid sequences of KYDVH (SEQ ID NO: 277), WMSHEGDKTESAQRFKG (SEQ ID NO: 278), and GSKHRLRDYVLYDDYGLINYQEWNDYLEFLDV (SEQ ID NO: 279), and a light chain with three CDRs that include an amino acid sequence selected from the group consisting of the amino acid sequences of SSTQSLRHSNGANYLA (SEQ ID NO: 286), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of GNTFSK (SEQ ID NO: 280), WMSHEGDKTE (SEQ ID NO: 281), GSKHRLRDYVLYDDYGLINYQEWNDYLEFLDV (SEQ ID NO: 279), and a light chain with three CDRs that include an amino acid sequence selected from the group consisting of the amino acid sequences of SSTQSLRHSNGANYLA (SEQ ID NO: 286), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of KYDVH (SEQ ID NO: 277), WI SHERDKTESAQRFKG (SEQ ID NO: 293), GSKHRLRDYVLYDDYGLINYQEWNDYLEFLDV (SEQ ID NO: 279), and a light chain with three CDRs that include an amino acid sequence selected from the group consisting of the amino acid sequences of SSTQSLRHSNGANYLA (SEQ ID NO: 286), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of GNTFSK (SEQ ID NO: 280), WISHERDKTE (SEQ ID NO: 294), GSKHRLRDYVLYDDYGLINYQEWNDYLE-FLDV (SEQ ID NO: 279), and a light chain with three CDRs that include an amino acid sequence selected from the group consisting of the amino acid sequences of SSTQSLRHSN-GANYLA (SEQ ID NO: 286), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of KYDVH (SEQ ID NO: 277), WMSHEGDKTESAQRFKG (SEQ ID NO: 278), and GSKHRLRDYVLYDDYGLINY-QEWNDYLEFLDV (SEQ ID NO: 279), and a light chain with three CDRs that include an amino acid sequence selected from the group consisting of the amino acid sequences of TSTQSLRHSNGANYLA (SEQ ID NO: 303), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of GNTFSK (SEQ ID NO: 280), WMSHEGDKTE (SEQ ID NO: 281), GSKHRLRDYVLYDDYGLINYQEWNDYLE-FLDV (SEQ ID NO: 279), and a light chain with three CDRs that include an amino acid sequence selected from the group consisting of the amino acid sequences of TSTQSLRHSN-GANYLA (SEQ ID NO: 303), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of KYDVH (SEQ ID NO: 277), WMSHEGDKTESAQRFKG (SEQ ID NO: 278), GSKHRLRDYVLYDDYGLIN-QQEWNDYLEFLDV (SEQ ID NO: 308), and a light chain with three CDRs that include an amino acid sequence selected from the group consisting of the amino acid sequences of TSTQSLRHSNGANYLA (SEQ ID NO: 303), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of GNTFRK (SEQ ID NO: 309), WMSHEGDKTE (SEQ ID NO: 281), and GSKHRLRDYVLYDDYGLINQQEWN-DYLEFLDV (SEQ ID NO: 308), and a light chain with three CDRs that include an amino acid sequence selected from the group consisting of the amino acid sequences of TSTQSL-RHSNGANYLA (SEQ ID NO: 303), LGSQRAS (SEQ ID NO: 287), and MQGLNRPWT (SEQ ID NO: 288).

The invention provides an isolated anti-HIV antibody, wherein said antibody may have a heavy chain with three CDRs which may comprise an amino acid sequence selected from the group consisting of the amino acid sequences of RCNYFWG (SEQ ID NO: 320), SLSHCRSYYNTDWT-YHNPSLKS (SEQ ID NO: 321), and FGGEVLVYRDWP-KPAWVDL (SEQ ID NO: 322), and a light chain with three CDRs that include an amino acid sequence selected from the group consisting of the amino acid sequences of TGTSN-NFVS (SEQ ID NO: 325), EVNKRPS (SEQ ID NO: 227), and SSLVGNWDVI (SEQ ID NO: 212).

The invention provides an isolated anti-HIV antibody, wherein said antibody may have a heavy chain with three CDRs which may comprise an amino acid sequence selected from the group consisting of the amino acid sequences of GDSTGRCN (SEQ ID NO: 323), SLSHCRSYYNTDWTY (SEQ ID NO: 324), and FGGEVLVYRDWPKPAWVDL (SEQ ID NO: 322), and a light chain with three CDRs that include an amino acid sequence selected from the group consisting of the amino acid sequences of TGTSNNFVS (SEQ ID NO: 325), EVNKRPS (SEQ ID NO: 227), and SSLVGNWDVI (SEQ ID NO: 212).

The invention provides an isolated anti-HIV antibody, wherein said antibody may have a heavy chain with three CDRs which may comprise an amino acid sequence selected from the group consisting of the amino acid sequences of ACNSFWG (SEQ ID NO: 326), SLSHCASYWNRGWT-YHNPSLKS (SEQ ID NO: 335), and FGGEVLRYTDWP-KPAWVDL (SEQ ID NO: 336), and a light chain with three CDRs that include an amino acid sequence selected from the group consisting of the amino acid sequences of TGTSN-NFVS (SEQ ID NO: 325), (SEQ ID NO: 343), and (SEQ ID NO: 196).

The invention provides an isolated anti-HIV antibody, wherein said antibody may have a heavy chain with three CDRs which may comprise an amino acid sequence selected from the group consisting of the amino acid sequences of GDSTAACN (SEQ ID NO: 337), SLSHCASYWNRGWTY (SEQ ID NO: 338), and FGGEVLRYTDWPKPAWVDL (SEQ ID NO: 336), and a light chain with three CDRs that include an amino acid sequence selected from the group consisting of the amino acid sequences of TGTSNNFVS (SEQ ID NO: 325), DVNKRPS (SEQ ID NO: 343), and GSLVGNWDVI (SEQ ID NO: 196).

The invention provides an isolated anti-HIV antibody, wherein said antibody may have a heavy chain with three CDRs which may comprise an amino acid sequence selected from the group consisting of the amino acid sequences of TGHHYWG (SEQ ID NO: 348), HIHYNTAVLHNPALKS (SEQ ID NO: 349), and SGGDILYYIEWQKPHWFYP (SEQ ID NO: 350), and a light chain with three CDRs that include an amino acid sequence selected from the group consisting of the amino acid sequences of SGTGSDIG-SWNFVS (SEQ ID NO: 357), EVNRRRS (SEQ ID NO: 358), and SSLSGRWDIV (SEQ ID NO: 359).

The invention provides an isolated anti-HIV antibody, wherein said antibody may have a heavy chain with three CDRs which may comprise an amino acid sequence selected from the group consisting of the amino acid sequences of GDSINTGH (SEQ ID NO: 351), HIHYNTAVL (SEQ ID NO: 352), and SGGDILYYIEWQKPHWFYP (SEQ ID NO: 350), and a light chain with three CDRs that include an amino acid sequence selected from the group consisting of the amino acid sequences of SGTGSDIGSWNFVS (SEQ ID NO: 357), EVNRRRS (SEQ ID NO: 358), and SSLSGR-WDIV (SEQ ID NO: 359).

The invention provides an isolated anti-HIV antibody, wherein said antibody may have a heavy chain with three CDRs which may comprise an amino acid sequence selected from the group consisting of the amino acid sequences of GGEWGDSDYHWG (SEQ ID NO: 364), SIHWRGT-THYNAPFRG (SEQ ID NO: 365), and HKYHDIVMVVPI-AGWFDP (SEQ ID NO: 366), and a light chain with three CDRs that include an amino acid sequence selected from the group consisting of the amino acid sequences of RASQS-VKNNLA (SEQ ID NO: 372), DTSSRAS (SEQ ID NO: 373), and QQYEEWPRT (SEQ ID NO: 245).

The invention provides an isolated anti-HIV antibody, wherein said antibody may have a heavy chain with three CDRs which may comprise an amino acid sequence selected from the group consisting of the amino acid sequences of GGSIRGGEWGDSD (SEQ ID NO: 367), SIHWRGTTH (SEQ ID NO: 237), and HKYHDIVMVVPIAGWFDP (SEQ ID NO: 366), and a light chain with three CDRs that include an amino acid sequence selected from the group consisting of the amino acid sequences of RASQSVKNNLA (SEQ ID NO: 372), DTSSRAS (SEQ ID NO: 373), and QQYEEWPRT (SEQ ID NO: 245).

The invention provides an isolated anti-HIV antibody, wherein said antibody may have a heavy chain with three CDRs which may comprise an amino acid sequence selected from the group consisting of the amino acid sequences of NHDVH (SEQ ID NO: 378), WMSHEGDKTGLAQKFQG (SEQ ID NO: 379), and GSKHRLRDYFLYNEYGPNYEE-WGDYLATLDV (SEQ ID NO: 380), and a light chain with three CDRs that include an amino acid sequence selected from the group consisting of the amino acid sequences of KCSHSLQHSTGANYLA (SEQ ID NO: 387), LATHRAS (SEQ ID NO: 388), and MQGLHSPWT (SEQ ID NO: 389).

The invention provides an isolated anti-HIV antibody, wherein said antibody may have a heavy chain with three CDRs which may comprise an amino acid sequence selected from the group consisting of the amino acid sequences of GNSFSN (SEQ ID NO: 381), WMSHEGDKTG (SEQ ID NO: 382), and GSKHRLRDYFLYNEYGPNYEEWGDY-LATLDV (SEQ ID NO: 380), and a light chain with three CDRs that include an amino acid sequence selected from the group consisting of the amino acid sequences of KCSHSLQHSTGANYLA (SEQ ID NO: 387), LATHRAS (SEQ ID NO: 388), and MQGLHSPWT (SEQ ID NO: 389).

The invention provides an isolated anti-HIV antibody, wherein said antibody may comprise a $V_H$ CDR1 region which may comprise the amino acid sequence of NYYWT (SEQ ID NO: 406); a $V_H$ CDR2 region which may comprise the amino acid sequence of YISDRETTTYNPSLNS (SEQ ID NO: 407); a $V_H$ CDR3 region which may comprise the amino acid sequence of ARRGQRIYGVVSFG-EFFYYYYMDV (SEQ ID NO: 408); a $V_L$ CDR1 region which may comprise the amino acid sequence of GRQALG-SRAVQ (SEQ ID NO: 415); a $V_L$ CDR2 region which may comprise the amino acid sequence of NNQDRPS (SEQ ID NO: 151); and a $V_L$ CDR3 region which may comprise the amino acid sequence of HMWDSRSGFSWS (SEQ ID NO: 416).

The invention provides an isolated anti-HIV antibody, wherein said antibody may comprise a $V_H$ CDR1 region which may comprise the amino acid sequence of GRFWS (SEQ ID NO: 421); a $V_H$ CDR2 region which may comprise the amino acid sequence of YFSDTDRSEYNPSLRS (SEQ ID NO: 422); a $V_H$ CDR3 region which may comprise the amino acid sequence of AQQGKRIYGIVSFG-EFFYYYYMDA (SEQ ID NO: 423); a $V_L$ CDR1 region which may comprise the amino acid sequence of GERSRG-SRAVQ (SEQ ID NO: 430); a $V_L$ CDR2 region which may comprise the amino acid sequence of NNQDRPA (SEQ ID NO: 179); and a $V_L$ CDR3 region which may comprise the amino acid sequence of HYWDSRSPISWI (SEQ ID NO: 431).

The invention provides an isolated anti-HIV antibody, wherein said antibody may comprise a $V_H$ CDR1 region which may comprise the amino acid sequence of GRFWS (SEQ ID NO: 421); a $V_H$ CDR2 region which may comprise the amino acid sequence of YFSDTDRSEYNPSLRS (SEQ ID NO: 422); a $V_H$ CDR3 region which may comprise the amino acid sequence of AQQGKRIYGIVSFGEL-FYYYYMDA (SEQ ID NO: 436); a $V_L$ CDR1 region which may comprise the amino acid sequence of GERSRGSRAVQ (SEQ ID NO: 430); a $V_L$ CDR2 region which may comprise the amino acid sequence of NNQDRPA (SEQ ID NO: 179); and a $V_L$ CDR3 region which may comprise the amino acid sequence of HYWDSRSPISWI (SEQ ID NO: 431).

The invention provides an isolated anti-HIV antibody, wherein said antibody may comprise a $V_H$ CDR1 region which may comprise the amino acid sequence of TGH-HYWG (SEQ ID NO: 348); a $V_H$ CDR2 region which may comprise the amino acid sequence of HIHYNTAVLHN-PALKS (SEQ ID NO: 349); a $V_H$ CDR3 region which may comprise the amino acid sequence of SGGDILYYNEWQK-PHWFYP (SEQ ID NO: 445); a $V_L$ CDR1 region which may comprise the amino acid sequence of SGTASDIGSWNFVS (SEQ ID NO: 450); a $V_L$ CDR2 region which may comprise the amino acid sequence of EVNRRRS (SEQ ID NO: 358); and a $V_L$ CDR3 region which may comprise the amino acid sequence of SSLSGRWDIV (SEQ ID NO: 359).

The invention provides an isolated anti-HIV antibody, wherein said antibody may comprise a $V_H$ CDR1 region which may comprise the amino acid sequence of ACDY-FWG (SEQ ID NO: 201); a $V_H$ CDR2 region which may comprise the amino acid sequence of SLSHCAGYYNSGW-TYHNPSLKS (SEQ ID NO: 455); a $V_H$ CDR3 region which may comprise the amino acid sequence of FGGDVLVYH-DWPKPAWVDL (SEQ ID NO: 456); a $V_L$ CDR1 region which may comprise the amino acid sequence of TGNIN-NFVS (SEQ ID NO: 458); a $V_L$ CDR2 region which may comprise the amino acid sequence of GVNKRPS (SEQ ID NO: 211); and a $V_L$ CDR3 region which may comprise the amino acid sequence of GSLAGNWDVV (SEQ ID NO: 459).

The invention provides an isolated anti-HIV antibody, wherein said antibody may comprise a $V_H$ CDR1 region which may comprise the amino acid sequence of GCDY-FWG (SEQ ID NO: 464); a $V_H$ CDR2 region which may comprise the amino acid sequence of GLSHCAGYYNTG-WTYHNPSLKS (SEQ ID NO: 202); a $V_H$ CDR3 region which may comprise the amino acid sequence of FDGEV-LVYNDWPKPAWVDL (SEQ ID NO: 465); a $V_L$ CDR1 region which may comprise the amino acid sequence of TGTSNNFVS (SEQ ID NO: 325); a $V_L$ CDR2 region which may comprise the amino acid sequence of GVNKRPS (SEQ ID NO: 211); and a $V_L$ CDR3 region which may comprise the amino acid sequence of GSLVGNWDVI (SEQ ID NO: 196).

The invention provides an isolated anti-HIV antibody, wherein said antibody may comprise a $V_H$ CDR1 region which may comprise the amino acid sequence of KYPMY (SEQ ID NO: 475); a $V_H$ CDR2 region which may comprise the amino acid sequence of AISGDAWHVVYSNSVQG (SEQ ID NO: 476); a $V_H$ CDR3 region which may comprise the amino acid sequence of MFQESGPPRLDRWS-GRNYYYYSGMDV (SEQ ID NO: 477); a $V_L$ CDR1 region which may comprise the amino acid sequence of KSSESL-RQSNGKTSLY (SEQ ID NO: 484); a $V_L$ CDR2 region which may comprise the amino acid sequence of EVSNRFS (SEQ ID NO: 485); and a $V_L$ CDR3 region which may comprise the amino acid sequence of MQSKDFPLT (SEQ ID NO: 486).

The invention provides an isolated anti-HIV antibody, wherein said antibody may comprise a $V_H$ CDR1 region which may comprise the amino acid sequence of KYPMY (SEQ ID NO: 475); a $V_H$ CDR2 region which may comprise the amino acid sequence of AISADAWHVVYSGSVQG (SEQ ID NO: 491); a VII CDR3 region which may comprise the amino acid sequence of MFQESGPPRFDSWS-GRNYYYYSGMDV (SEQ ID NO: 492); a $V_L$ CDR1 region which may comprise the amino acid sequence of KSSQS-LRQSNGKTSLY (SEQ ID NO: 498); a $V_L$ CDR2 region which may comprise the amino acid sequence of EVSNRFS (SEQ ID NO: 485); and a V$_L$ CDR3 region which may comprise the amino acid sequence of (MQSKDFPLT (SEQ ID NO: 486).

The invention provides an isolated anti-HIV antibody, wherein said antibody may comprise a V$_H$ CDR1 region which may comprise the amino acid sequence of KRHMH (SEQ ID NO: 503); a V$_H$ CDR2 region which may comprise the amino acid sequence of VISSDAIHVDYASSVRG (SEQ ID NO: 504); a V$_H$ CDR3 region which may comprise the amino acid sequence of DRDGYGPPQIQTWSGRYL-HLYSGIDA (SEQ ID NO: 505); a V$_L$ CDR1 region which may comprise the amino acid sequence of KSSQSL-RQSNGKTYLY (SEQ ID NO: 512); a V$_L$ CDR2 region which may comprise the amino acid sequence of EVSIRFS (SEQ ID NO: 513); and a V$_L$ CDR3 region which may comprise the amino acid sequence of MQSKDFPLT (SEQ ID NO: 486).

The invention provides an isolated anti-HIV antibody, wherein said antibody may comprise a V$_H$ CDR1 region which may comprise the amino acid sequence of KYPMY (SEQ ID NO: 475); a V$_H$ CDR2 region which may comprise the amino acid sequence of AISADAWHVDYAASVKD (SEQ ID NO: 518); a V$_H$ CDR3 region which may comprise the amino acid sequence of NIEEFSVPQFDSWSGRSYY-HYFGMDV (SEQ ID NO: 519); a V$_L$ CDR1 region which may comprise the amino acid sequence of SSS-ESLGRGDGRTYLH (SEQ ID NO: 526); a V$_L$ CDR2 region which may comprise the amino acid sequence of EVSTRFS (SEQ ID NO: 527); and a V$_L$ CDR3 region which may comprise the amino acid sequence of MQSRDFPIT (SEQ ID NO: 528).

The invention provides an isolated anti-HIV antibody, wherein said antibody may comprise a V$_H$ CDR1 region which may comprise the amino acid sequence of EYPMY (SEQ ID NO: 533); a V$_H$ CDR2 region which may comprise the amino acid sequence of AISADAWHVDYAGSVRG (SEQ ID NO: 534); a V$_H$ CDR3 region which may comprise the amino acid sequence of DGEEHKVPQLHSWSGRN-LYHYTGFDV (SEQ ID NO: 535); a V$_L$ CDR1 region which may comprise the amino acid sequence of KSSQSVRQS-DGKTFLY (SEQ ID NO: 541); a V$_L$ CDR2 region which may comprise the amino acid sequence of EGSSRFS (SEQ ID NO: 542); and a V$_L$ CDR3 region which may comprise the amino acid sequence of LQTKDFPLT (SEQ ID NO: 543).

The invention provides an isolated anti-HIV antibody, wherein said antibody may comprise a V$_H$ CDR1 region which may comprise the amino acid sequence of QYPMY (SEQ ID NO: 548); a V$_H$ CDR2 region which may comprise the amino acid sequence of AISADAWHVDYPGSVRG (SEQ ID NO: 549); a V$_H$ CDR3 region which may comprise the amino acid sequence of DGEEHKVPQLHSWSGRN-LYHYTGFDV (SEQ ID NO: 535); a V$_L$ CDR1 region which may comprise the amino acid sequence of KSSQTVRQS-DGKTFLY (SEQ ID NO: 555); a V$_L$ CDR2 region which may comprise the amino acid sequence of EGSNRFS (SEQ ID NO: 556); and a V$_L$ CDR3 region which may comprise the amino acid sequence of LQTKDFPLT (SEQ ID NO: 543).

The invention provides an isolated anti-HIV antibody, wherein said antibody may comprise a V$_H$ CDR1 region which may comprise the amino acid sequence of QYPMY (SEQ ID NO: 548); a V$_H$ CDR2 region which may comprise the amino acid sequence of AISADAWHVDYAGSVRG (SEQ ID NO: 534); a V$_H$ CDR3 region which may comprise the amino acid sequence of DGEEHEVPQLHSWSGRNLY-HYTGVDI (SEQ ID NO: 561); a V$_L$ CDR1 region which may comprise the amino acid sequence of KSSQSLRQS-DGKTFLY (SEQ ID NO: 567); a V$_L$ CDR2 region which may comprise the amino acid sequence of EASNRFS (SEQ ID NO: 568); and a V$_L$ CDR3 region which may comprise the amino acid sequence of MQTKDFPLT (SEQ ID NO: 569).

The invention provides an isolated anti-HIV antibody, wherein said antibody may comprise a V$_H$ CDR1 region which may comprise the amino acid sequence of KYPMY (SEQ ID NO: 475); a V$_H$ CDR2 region which may comprise the amino acid sequence of AISADAWHVDYPGSVRG (SEQ ID NO: 549); a V$_H$ CDR3 region which may comprise the amino acid sequence of DGEEHEVPQLHSWSGRNLY-HYTGVDV (SEQ ID NO: 574); a V$_L$ CDR1 region which may comprise the amino acid sequence of KSSQSVRQS-DGKTFLY (SEQ ID NO: 541); a V$_L$ CDR2 region which may comprise the amino acid sequence of EASKRFS (SEQ ID NO: 580); and a V$_L$ CDR3 region which may comprise the amino acid sequence of MQTKDFPLT (SEQ ID NO: 569).

The invention also provides an isolated anti-HIV antibody, wherein said antibody has a heavy chain with three CDRs including an amino acid sequence selected from the group consisting of the amino acid sequences of KYGMH (SEQ ID NO: 88), LISDDGMRKYHSDSMWG (SEQ ID NO: 89), EAGGPIWHDDVKYYDFNDGYYNYHYMDV (SEQ ID NO: 6), SYAFT (SEQ ID NO: 104), MVTPIF-GEAKYSQRFEG (SEQ ID NO: 105), DRRAVPIATDN-WLDP (SEQ ID NO: 9), SYAFS (SEQ ID NO: 110), MITPVFGETKYAPRFQG (SEQ ID NO: 111), DRRVVP-MATDNWLDP (SEQ ID NO: 8), DYYLH (SEQ ID NO: 116), LIDPENGEARYAEKFQG (SEQ ID NO: 117), GAV-GADSGSWFDP (SEQ ID NO: 10), RQGMH (SEQ ID NO: 123), FIKYDGSEKYHADSVWG (SEQ ID NO: 124), EAGGPDYRNGYNYYDFYDGYYNYHYMDV (SEQ ID NO: 7), LISDDGMRKYHSNSMWG (SEQ ID NO: 98), DSYWS (SEQ ID NO: 90), YVHKSGDTNYSPSLKS (SEQ ID NO: 265), TLHGRRIYGIVAFNEWFTYFYMDV (SEQ ID NO: 143), DNYWS (SEQ ID NO: 261), YVHDSGDT-NYNPSLKS (SEQ ID NO: 157), TKHGRRIYGV-VAFKEWFTYFYMDV (SEQ ID NO: 262), DAYWS (SEQ ID NO: 169), YVHHSGDTNYNPSLKR (SEQ ID NO: 170), ALHGKRIYGIVALGELFTYFYMDV (SEQ ID NO: 171), ACTYFWG (SEQ ID NO: 185), SLSHCQSFWGS-GWTFHNPSLKS (SEQ ID NO: 186), FDGEVLVYNHWP-KPAWVDL (SEQ ID NO: 187), ACDYFWG (SEQ ID NO: 201), GLSHCAGYYNTGWTYHNPSLKS (SEQ ID NO: 202), FDGEVLVYHDWPKPAWVDL (SEQ ID NO: 203), TGHYYWG (SEQ ID NO: 217), HIHYTTAVLHNPSLKS (SEQ ID NO: 218), SGGDILYYYEWQKPHWFSP (SEQ ID NO: 219), GGEWGDKDYHWG (SEQ ID NO: 233), SIHWRGTTHYKESLRR (SEQ ID NO: 234), HRHHDVF-MLVPIAGWFDV (SEQ ID NO: 235), GTDWGENDFHYG (SEQ ID NO: 250), SIHWRGRTTHYKTSFRS (SEQ ID NO: 251), HKYHDIFRVVPVAGWFDP (SEQ ID NO: 252), KYDVH (SEQ ID NO: 277), WMSHEGDKTESAQRFKG (SEQ ID NO: 278), GSKHRLRDYVLYDDYGLINY-QEWNDYLEFLDV (SEQ ID NO: 279), WISHERDKTE-SAQRFKG (SEQ ID NO: 293), and GSKHRLRDYVLYD-DYGLINQQEWNDYLEFLDV (SEQ ID NO: 308), wherein said antibody binds to and neutralizes HIV-1. Optionally, this antibody has a light chain with three CDRs that include an amino acid sequence selected from the group consisting of the amino acid sequences of NGTSSDVG-GFDSVS (SEQ ID NO: 97), DVSHRPS (SEQ ID NO: 95), SSLTDRSHRI (SEQ ID NO: 41), RASQTINNYLN (SEQ ID NO: 107), GASNLQN (SEQ ID NO: 108), QQSFSTPRT (SEQ ID NO: 42), RASQTIHTYLN (SEQ ID NO: 113), GASTLQS (SEQ ID NO: 114), QQSYSTPRT (SEQ ID NO: 43), SGSKLGDKYVS (SEQ ID NO: 120), ENDRRPS (SEQ ID NO: 121), QAWETTTTTFVF (SEQ ID NO: 44), NGTSNDVGGYESVS (SEQ ID NO: 126), DVSKRPS (SEQ ID NO: 127), KSLTSTRRRV (SEQ ID NO: 45), NGTRSDVGGFDSVS (SEQ ID NO: 92), NGTSRDVG-GFDSVS (SEQ ID NO: 93), GEKSLGSRAVQ (SEQ ID NO: 150), NNQDRPS (SEQ ID NO: 151), HIWDSRVPT-KWV (SEQ ID NO: 152), GEESLGSRSVI (SEQ ID NO: 162), NNNDRPS (SEQ ID NO: 163), HIWDSRRPTNWV (SEQ ID NO: 164), GKESIGSRAVQ (SEQ ID NO: 178), NNQDRPA (SEQ ID NO: 179), HIYDARGGTNWV (SEQ ID NO: 180), NGTATNFVS (SEQ ID NO: 194), GVDKRPP (SEQ ID NO: 195), GSLVGNWDVI (SEQ ID NO: 196), TGTSNRFVS (SEQ ID NO: 210), GVNKRPS (SEQ ID NO: 211), SSLVGNWDVI (SEQ ID NO: 212), NGTSS-DIGGWNFVS (SEQ ID NO: 226), EVNKRPS (SEQ ID NO: 227), SSLFGRWDVV (SEQ ID NO: 228), RASQNINKNLA (SEQ ID NO: 243), ETYSKIA (SEQ ID NO: 244), QQYEEWPRT (SEQ ID NO: 245), RASQN-VKNNLA (SEQ ID NO: 259), DASSRAG (SEQ ID NO: 260), SSTQSLRHSNGANYLA (SEQ ID NO: 286), LGSQRAS (SEQ ID NO: 287), and MQGLNRPWT (SEQ ID NO: 288), and TSTQSLRHSNGANYLA (SEQ ID NO: 303).

The invention provides an isolated anti-HIV antibody, wherein said antibody has a light chain with three CDRs that include an amino acid sequence selected from the group consisting of the amino acid sequences of NGTSSDVG-GFDSVS (SEQ ID NO: 97), DVSHRPS (SEQ ID NO: 95), SSLTDRSHRI (SEQ ID NO: 41), RASQTINNYLN (SEQ ID NO: 107), GASNLQN (SEQ ID NO: 108), QQSFSTPRT (SEQ ID NO: 42), RASQTIHTYLN (SEQ ID NO: 113), GASTLQS (SEQ ID NO: 114), QQSYSTPRT (SEQ ID NO: 43), SGSKLGDKYVS (SEQ ID NO: 120), ENDRRPS (SEQ ID NO: 121), QAWETTTTTFVF (SEQ ID NO: 44), NGTSNDVGGYESVS (SEQ ID NO: 126), DVSKRPS (SEQ ID NO: 127), KSLTSTRRRV (SEQ ID NO: 45), NGTRSDVGGFDSVS (SEQ ID NO: 92), NGTSRDVG-GFDSVS (SEQ ID NO: 93), GEKSLGSRAVQ (SEQ ID NO: 150), NNQDRPS (SEQ ID NO: 151), HIWDSRVPT-KWV (SEQ ID NO: 152), GEESLGSRSVI (SEQ ID NO: 162), NNNDRPS (SEQ ID NO: 163), HIWDSRRPTNWV (SEQ ID NO: 164), GKESIGSRAVQ (SEQ ID NO: 178), NNQDRPA (SEQ ID NO: 179), HIYDARGGTNWV (SEQ ID NO: 180), NGTATNFVS (SEQ ID NO: 194), GVDKRPP (SEQ ID NO: 195), GSLVGNWDVI (SEQ ID NO: 196), TGTSNRFVS (SEQ ID NO: 210), GVNKRPS (SEQ ID NO: 211), SSLVGNWDVI (SEQ ID NO: 212), NGTSS-DIGGWNFVS (SEQ ID NO: 226), EVNKRPS (SEQ ID NO: 227), SSLFGRWDVV (SEQ ID NO: 228), RASQNINKNLA (SEQ ID NO: 243), ETYSKIA (SEQ ID NO: 244), QQYEEWPRT (SEQ ID NO: 245), RASQN-VKNNLA (SEQ ID NO: 259), DASSRAG (SEQ ID NO: 260), SSTQSLRHSNGANYLA (SEQ ID NO: 286), LGSQRAS (SEQ ID NO: 287), and MQGLNRPWT (SEQ ID NO: 288), and TSTQSLRHSNGANYLA (SEQ ID NO: 303), wherein said antibody binds to and neutralizes HIV-1.

The invention provides an isolated anti-HIV antibody, wherein said antibody has a heavy chain with three CDRs which may comprise an amino acid sequence selected from the group consisting of the amino acid sequences of GFT-FHK (SEQ ID NO: 266), LISDDGMRKY (SEQ ID NO: 267), and EAGGPIWHDDVKYYDFNDGYYNYHYMDV (SEQ ID NO: 6), GGTFSS (SEQ ID NO: 268), MVTPIF-GEAK (SEQ ID NO: 269), and DRRAVPIATDNWLDP (SEQ ID NO: 9), GGAFSS (SEQ ID NO: 270), MITPVF-GETK (SEQ ID NO: 271), DRRVVPMATDNWLDP (SEQ ID NO: 8), GYSFID (SEQ ID NO: 102), LIDPENGEAR (SEQ ID NO: 103), GAVGADSGSWFDP (SEQ ID NO: 10), GFDFSR (SEQ ID NO: 118), FIKYDGSEKY (SEQ ID NO: 272), and EAGGPDYRNGYNYYDFYDGYYNY-HYMDV (SEQ ID NO: 7), GASISD (SEQ ID NO: 144), YVHKSGDTN (SEQ ID NO: 145), TLHGRRIYGIVAF-NEWFTYFYMDV (SEQ ID NO: 143), GTLVRD (SEQ ID NO: 263), YVHDSGDTN (SEQ ID NO: 264), TKHGRRI-YGVVAFKEWFTYFYMDV (SEQ ID NO: 262), GASIND (SEQ ID NO: 172), YVHHSGDTN (SEQ ID NO: 173), ALHGKRIYGIVALGELFTYFYMDV (SEQ ID NO: 171), GESTGACT (SEQ ID NO: 188), SLSHCQSFWGSGWTF (SEQ ID NO: 189), FDGEVLVYNHWPKPAWVDL (SEQ ID NO: 187), GDSTAACD (SEQ ID NO: 204), GLSHCA-GYYNTGWTY (SEQ ID NO: 205), FDGEVLVYHDWP-KPAWVDL (SEQ ID NO: 203), GESINTGH (SEQ ID NO: 220), HIHYTTAVL (SEQ ID NO: 221), SGGDI-LYYYEWQKPHWFSP (SEQ ID NO: 219), GDSIRGGEWGDKD (SEQ ID NO: 236), SIHWRGTTH (SEQ ID NO: 237), HRHHDVFMLVPIAGWFDV (SEQ ID NO: 235), GGSMRGTDWGEND (SEQ ID NO: 253), SIH-WRGRTTH (SEQ ID NO: 254), HKYHDIFRVVPVAG-WFDP (SEQ ID NO: 252), GNTFSK (SEQ ID NO: 280), WMSHEGDKTE (SEQ ID NO: 281), GSKHRLRDYV-LYDDYGLINYQEWNDYLEFLDV (SEQ ID NO: 279), WISHERDKTE (SEQ ID NO: 294), GNTFRK (SEQ ID NO: 309), and GSKHRLRDYVLYDDYGLINQQEWN-DYLEFLDV (SEQ ID NO: 308), wherein said antibody binds to and neutralizes HIV-1. Optionally, this antibody has a light chain with three CDRs that include an amino acid sequence selected from the group consisting of the amino acid sequences of NGTSSDVGGFDSVS (SEQ ID NO: 97), DVSHRPS (SEQ ID NO: 95), SSLTDRSHRI (SEQ ID NO: 41), RASQTINNYLN (SEQ ID NO: 107), GASNLQN (SEQ ID NO: 108), QQSFSTPRT (SEQ ID NO: 42), RASQTIHTYLN (SEQ ID NO: 113), GASTLQS (SEQ ID NO: 114), QQSYSTPRT (SEQ ID NO: 43), SGSKLGD-KYVS (SEQ ID NO: 120), ENDRRPS (SEQ ID NO: 121), QAWETTTTTFVF (SEQ ID NO: 44), NGTSNDVG-GYESVS (SEQ ID NO: 126), DVSKRPS (SEQ ID NO: 127), KSLTSTRRRV (SEQ ID NO: 45), NGTRSDVG-GFDSVS (SEQ ID NO: 92), NGTSRDVGGFDSVS (SEQ ID NO: 93), GEKSLGSRAVQ (SEQ ID NO: 150), NNQDRPS (SEQ ID NO: 151), HIWDSRVPTKWV (SEQ ID NO: 152), GEESLGSRSVI (SEQ ID NO: 162), NNNDRPS (SEQ ID NO: 163), HIWDSRRPTNWV (SEQ ID NO: 164), GKESIGSRAVQ (SEQ ID NO: 178), NNQDRPA (SEQ ID NO: 179), HIYDARGGTNWV (SEQ ID NO: 180), NGTATNFVS (SEQ ID NO: 194), GVDKRPP (SEQ ID NO: 195), GSLVGNWDVI (SEQ ID NO: 196), TGTSNRFVS (SEQ ID NO: 210), GVNKRPS (SEQ ID NO: 211), SSLVGNWDVI (SEQ ID NO: 212), NGTSS-DIGGWNFVS (SEQ ID NO: 226), EVNKRPS (SEQ ID NO: 227), SSLFGRWDVV (SEQ ID NO: 228), RASQNINKNLA (SEQ ID NO: 243), ETYSKIA (SEQ ID NO: 244), QQYEEWPRT (SEQ ID NO: 245), RASQN-VKNNLA (SEQ ID NO: 259), DASSRAG (SEQ ID NO: 260), SSTQSLRHSNGANYLA (SEQ ID NO: 286), LGSQRAS (SEQ ID NO: 287), and MQGLNRPWT (SEQ ID NO: 288), and TSTQSLRHSNGANYLA (SEQ ID NO: 303).

Moreover, the invention provides an isolated anti-HIV antibody or fragment thereof, wherein said antibody includes: (a) a $V_H$ CDR1 region including the amino acid sequence of SEQ ID NO: 88, 104, 110, 116, 123, 90, 261, 169, 185, 201, 217, 233, 250, or 277; (b) a $V_H$ CDR2 region including the amino acid sequence of SEQ ID NO: 98, 89, 105, 111, 117, 124, 265, 157, 170, 186, 202, 218, 234, 251, 278, or 293; and (c) a $V_H$ CDR3 region including the amino acid sequence of SEQ ID NO: 6, 9, 8, 10, 7, 143, 262, 171, 187, 203, 219, 235, 252, 279, or 308; wherein said antibody binds to and neutralizes HIV-1. This antibody may further includes: (a) a $V_L$ CDR1 region including the amino acid sequence of SEQ ID NO: 93, 92, 97, 94, 107, 113, 120, 126, 150, 162, 178, 194, 210, 226, 243, 259, 286 or 303; (b) a $V_L$ CDR2 region including the amino acid sequence of SEQ ID NO: 95, 108, 114, 121, 127, 151, 163, 179, 195, 211, 227, 244, 260, or 287; and (c) a $V_L$ CDR3 region including the amino acid sequence of SEQ ID NO: 41, 42, 43, 44, 45, 152, 164, 180, 196, 212, 228, 245, or 288.

Alternatively, the invention provides an isolated anti-HIV antibody or fragment thereof, wherein said antibody includes: (a) a $V_H$ CDR1 region including the amino acid sequence of SEQ ID NO: 266, 268, 270, 201, 118, 144, 263, 172, 188, 204, 220, 236, 253, 280 or 309; (b) a $V_H$ CDR2 region including the amino acid sequence of SEQ ID NO: 267, 269, 271, 103, 272, 145, 264, 173, 189, 205, 221, 237, 254, 281, or 294; and (c) a $V_H$ CDR3 region including the amino acid sequence of SEQ ID NO: 6, 9, 8, 10, 7, 143, 262, 171, 187, 203, 219, 235, 252, 279, or 308; wherein said antibody binds to and neutralizes HIV-1. This antibody may further include: (a) a $V_L$ CDR1 region including the amino acid sequence of SEQ ID NO: 93, 92, 97, 94, 107, 113, 120, 126, 150, 162, 178, 194, 210, 226, 243, 259, 286 or 303; (b) a $V_L$ CDR2 region including the amino acid sequence of SEQ ID NO: 95, 108, 114, 121, 127, 151, 163, 179, 195, 211, 227, 244, 260, or 287; and (c) a $V_L$ CDR3 region including the amino acid sequence of SEQ ID NO: 41, 42, 43, 44, 45, 152, 164, 180, 196, 212, 228, 245, or 288.

The invention provides an isolated fully human monoclonal anti-HIV antibody including: a) a heavy chain sequence including the amino acid sequence of SEQ ID NO: 31 and a light chain sequence including amino acid sequence SEQ ID NO: 32, orb) a heavy chain sequence including the amino acid sequence of SEQ ID NO: 33 and a light chain sequence including amino acid sequence SEQ ID NO: 34, or c) a heavy chain sequence including the amino acid sequence of SEQ ID NO: 35 and a light chain sequence which may comprise amino acid sequence SEQ ID NO: 36, or d) a heavy chain sequence including the amino acid sequence of SEQ ID NO: 37 and a light chain sequence including amino acid sequence SEQ ID NO: 38, or e) a heavy chain sequence including the amino acid sequence of SEQ ID NO: 39 and a light chain sequence including amino acid sequence SEQ ID NO: 40, or f) a heavy chain sequence including the amino acid sequence of SEQ ID NO: 140 and a light chain sequence including amino acid sequence SEQ ID NO: 96, or g) a heavy chain sequence including the amino acid sequence of SEQ ID NO: 48 and a light chain sequence including amino acid sequence SEQ ID NO: 51, or h) a heavy chain sequence including the amino acid sequence of SEQ ID NO: 54 and a light chain sequence including amino acid sequence SEQ ID NO: 57, or i) a heavy chain sequence including the amino acid sequence of SEQ ID NO: 60 and a light chain sequence including amino acid sequence SEQ ID NO: 32, or j) a heavy chain sequence which may comprise the amino acid sequence of SEQ ID NO: 79 and a light chain sequence which may comprise amino acid sequence SEQ ID NO: 149, or k) a heavy chain sequence which may comprise the amino acid sequence of SEQ ID NO: 156 and a light chain sequence which may comprise amino acid sequence SEQ ID NO: 161, or 1) a heavy chain sequence which may comprise the amino acid sequence of SEQ ID NO: 168 and a light chain sequence which may comprise amino acid sequence SEQ ID NO: 177, or m) a heavy chain sequence which may comprise the amino acid sequence of SEQ ID NO: 184 and a light chain sequence which may comprise amino acid sequence SEQ ID NO: 193, or n) a heavy chain sequence which may comprise the amino acid sequence of SEQ ID NO: 200 and a light chain sequence which may comprise amino acid sequence SEQ ID NO: 209, or o) a heavy chain sequence which may comprise the amino acid sequence of SEQ ID NO: 216 and a light chain sequence which may comprise amino acid sequence SEQ ID NO: 225, or p) a heavy chain sequence which may comprise the amino acid sequence of SEQ ID NO: 232 and a light chain sequence which may comprise amino acid sequence SEQ ID NO: 242 or q) a heavy chain sequence which may comprise the amino acid sequence of SEQ ID NO: 249 and a light chain sequence which may comprise amino acid sequence SEQ ID NO: 258 or r) a heavy chain sequence which may comprise the amino acid sequence of SEQ ID NO: 276 and a light chain sequence which may comprise amino acid sequence SEQ ID NO: 285 or s) a heavy chain sequence which may comprise the amino acid sequence of SEQ ID NO: 292 and a light chain sequence which may comprise amino acid sequence SEQ ID NO: 285 or t) a heavy chain sequence which may comprise the amino acid sequence of SEQ ID NO: 298 and a light chain sequence which may comprise amino acid sequence SEQ ID NO: 302 or u) a heavy chain sequence which may comprise the amino acid sequence of SEQ ID NO: 307 and a light chain sequence which may comprise amino acid sequence SEQ ID NO: 313 or v) a heavy chain sequence which may comprise the amino acid sequence of SEQ ID NO: 319 and a light chain sequence which may comprise amino acid sequence SEQ ID NO: 330 or w) a heavy chain sequence which may comprise the amino acid sequence of SEQ ID NO: 334 and a light chain sequence which may comprise amino acid sequence SEQ ID NO: 393 or x) a heavy chain sequence which may comprise the amino acid sequence of SEQ ID NO: 347 and a light chain sequence which may comprise amino acid sequence SEQ ID NO: 356 or y) a heavy chain sequence which may comprise the amino acid sequence of SEQ ID NO: 363 and a light chain sequence which may comprise amino acid sequence SEQ ID NO: 397 or z) a heavy chain sequence which may comprise the amino acid sequence of SEQ ID NO: 401 and a light chain sequence which may comprise amino acid sequence SEQ ID NO: 386, or aa) a heavy chain sequence which may comprise the amino acid sequence of SEQ ID NO: 405 and a light chain sequence which may comprise amino acid sequence SEQ ID NO: 414, or ab) a heavy chain sequence which may comprise the amino acid sequence of SEQ ID NO: 420 and a light chain sequence which may comprise amino acid sequence SEQ ID NO: 429, or ac) a heavy chain sequence which may comprise the amino acid sequence of SEQ ID NO: 435 and a light chain sequence which may comprise amino acid sequence SEQ ID NO: 440, or ad) a heavy chain sequence which may comprise the amino acid sequence of SEQ ID NO: 444 and a light chain sequence which may comprise amino acid sequence SEQ ID NO: 449, or ae) a heavy chain sequence which may comprise the amino acid sequence of SEQ ID NO: 454 and a light chain sequence which may comprise amino acid sequence SEQ ID NO: 584, or af) a heavy chain sequence which may comprise the amino acid sequence of SEQ ID NO: 463 and a light chain sequence which may comprise amino acid sequence SEQ ID NO: 470, or ag) a heavy chain sequence which may comprise the amino acid sequence of SEQ ID NO: 474 and a light chain sequence which may comprise amino acid sequence SEQ ID NO: 483, or ah) a heavy chain sequence which may comprise the amino acid sequence of SEQ ID NO: 490 and a light chain sequence which may comprise amino acid sequence SEQ ID NO: 497, or ai) a heavy chain sequence which may comprise the amino acid sequence of SEQ ID NO: 502 and a light chain sequence which may comprise amino acid sequence SEQ ID NO: 511, or aj) a heavy chain sequence which may comprise the amino acid sequence of SEQ ID NO: 517 and a light chain sequence which may comprise amino acid sequence SEQ ID NO: 525, or ak) a heavy chain sequence which may comprise the amino acid sequence of SEQ ID NO: 532 and a light chain sequence which may comprise amino acid sequence SEQ ID NO: 540, or al) a heavy chain sequence which may comprise the amino acid sequence of SEQ ID NO: 547 and a light chain sequence which may comprise amino acid sequence SEQ ID NO: 554, or am) a heavy chain sequence which may comprise the amino acid sequence of SEQ ID NO: 560 and a light chain sequence which may comprise amino acid sequence SEQ ID NO: 566.

The invention provides a composition including any one of the isolated anti-HIV antibodies described herein.

Optionally, an anti-HIV human monoclonal antibody of the invention is isolated from a B-cell from an HIV-1-infected human donor. In some embodiments, the antibody is effective in neutralizing a plurality of different clades of HIV. In some embodiments, the antibody is effective in neutralizing a plurality of different strain within the same clade of HIV-1. In some embodiments, the neutralizing antibody binds to the HIV envelope proteins gp120, or gp41 or envelope protein on HIV-1 pseudovirions or expressed on transfected or infected cell surfaces. In some embodiments, the neutralizing antibody does not bind to recombinant or monomeric envelope proteins gp120, or gp41 or envelope protein on HIV-1 pseudovirions or expressed on transfected or infected cell surfaces but binds to natural trimeric forms of the H1V-1 Env proteins.

The present invention provides human monoclonal antibodies wherein the antibodies are potent, broadly neutralizing antibody (bNAb). In some embodiments, a broadly neutralizing antibody is defined as a bNAb that neutralizes HIV-1 species belonging to two or more different clades. In some embodiments the different clades are selected from the group consisting of clades A, B, C, D, E, AE, AG, G or F. In some embodiments the HIV-1 strains from two or more clades comprise virus from non-B clades.

In some embodiments, a broadly neutralizing antibody is defined as a bNAb that neutralizes at least 60% of the HIV-1 strains listed in Tables 18A-18F. In some embodiments, at least 70%, or at least 80%, or at least 90% of the HIV-1 strains listed in Tables 18A-18F are neutralized.

In some embodiments, a potent, broadly neutralizing antibody is defined as a bNAb that displays a potency of neutralization of at least a plurality of HIV-1 species with an IC50 value of less than 0.2 μg/mL. In some embodiments the potency of neutralization of the HIV-1 species has an IC50 value of less than 0.15 μg/mL, or less than 0.10 μg/mL, or less than 0.05 μg/mL. A potent, broadly neutralizing antibody is also defined as a bNAb that displays a potency of neutralization of at least a plurality of HIV-1 species with an IC90 value of less than 2.0 μg/mL. In some embodiments the potency of neutralization of the HIV-1 species has an IC90 value of less than 1.0 μg/mL, or less than 0.5 μg/mL.

Exemplary monoclonal antibodies that neutralize HIV-1 include 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858 P08 (PGT-123), 6123_A06 (PGT-125), 5141_B17 (PGT-126), 5145_B14 (PGT-127), 5114_A19 (PGT-128), 5147_1\106 (PGT-130), 5136_H01 (PGT-131), 5343_1308 (PGT-135), 5344_E16 (PGT-135), 5329_C19 (PGT-136), 5366_P21 (PGT-136), 4964_G22 (PGT-141), 5345_101 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_1\406 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158) described herein. Alternatively, the monoclonal antibody is an antibody that binds to the same epitope as 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_1\110 (PGT-139), 6831_A21 (PGT-151), 6889_117 (PGT-152), 6891_F06 (PGT-153), 6843_G20 (PGT-154), 6892_D19 (PGT-155), 6808_B09 (PGT-156), 6892_C23 (PGT-157), or 6881_N05 (PGT-158). Specifically, monoclonal antibodies PG9 and PG16 are broad and potent neutralizing antibodies. The antibodies are respectively referred to herein as HIV antibodies.

The invention provides a number of isolated human monoclonal antibodies, wherein each said monoclonal antibody binds to HIV-1 infected or transfected cells; and binds to HIV-1 virus. A neutralizing antibody having potency in neutralizing HIV-1, or a fragment thereof is provided. In some embodiments a neutralizing antibody of the invention exhibits higher neutralization index and/or a higher affinity for binding to the envelope proteins gp120, or gp41 than anti-HIV mAbs known in the art, such as the mAb b12. (Burton D R et al., Science Vol. 266. no. 5187, pp. 1024-1027). Exemplary monoclonal antibodies 1496S09 (PG9), 1443_C16 (PG16), 1456_P20 (PG20), 1460_G14 (PGG14), and 1495_C14 (PGC14) exhibit binding to the envelope glycoprotein gp120, but not gp41, in an ELISA assay, however gp120 binding does not always correlate with neutralization activity against specific strains of HIV-1. In some embodiments, monoclonal antibodies, for example 1443_C16 (PG16) and 1496_C09 (PG9), display none or weak gp120 binding activity against a particular strain but bind to HIV-1 trimer on transfected or infected cell surface and/or virion and exhibit broad and potent neutralization activity against that strain of HIV-1.

In one aspect the antibody is a monoclonal antibody which may comprise one or more polypeptides selected from the group consisting of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_020 (PGT-154), 6892_D19 (PGT-155), 6808_B09 (PGT-156), 6892_C23 (PGT-157), and 6881_N05 (PGT-158); which may comprise a heavy chain selected from the group consisting of the heavy chain of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_014 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_022 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_020 (PGT-154), 6892_D19 (PGT-155), 6808_B09 (PGT-156), 6892_C23 (PGT-157), and 6881_N05 (PGT-158); which may comprise a heavy chain which may comprise a CDR selected from the group consisting of the CDRs of the heavy chain of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136 H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (POT-134), 5131_A17 (PGT-132), 5138_007 (PGT-138), 5120_N10 (PGT-139), 6831_A21 (PGT-151), 6889_117 (PGT-152), 6891_F06 (PGT-153), 6843_020 (PGT-154), 6892_D19 (PGT-155), 6808_B09 (PGT-156), 6892_C23 (PGT-157), and 6881_N05 (PGT-158); which may comprise a light chain selected from the group consisting of the light chain of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495S14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329S19 (PGT-136), 5366_P21 (PGT-136), 4964_G22 (PGT-141), 5345_101 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158); which may comprise a light chain which may comprise a CDR selected from the group consisting of the CDRs of the light chain of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158).

The invention relates to an antibody or a fragment thereof, such as Fab, Fab', F(ab')2 and Fv fragments that binds to an epitope or immunogenic polypeptide capable of binding to an antibody selected from 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158).

The invention also relates to immunogenic polypeptides encoding such epitopes.

Nucleic acid molecules encoding such antibodies, and vectors and cells carrying such nucleic acids are also provided.

The invention relates to a pharmaceutical composition which may comprise at least one antibody or fragment as recited herein, together with a pharmaceutically acceptable carrier.

The invention relates to a method of immunizing, preventing or inhibiting HIV infection or an HIV-related disease which may comprise the steps of identifying a patient in need of such treatment and administering to said patient a therapeutically effective amount of at least one monoclonal antibody as recited herein.

In a further aspect the HIV antibodies according to the invention are linked to a therapeutic agent or a detectable label.

Additionally, the invention provides methods for stimulating an immune response, treating, preventing or alleviating a symptom of an HIV viral infection by administering an HIV antibody to a subject In another aspect, the invention provides methods of administering the HIV antibody of the invention to a subject prior to, and/or after exposure to an HIV virus. For example, the HIV antibody of the invention is used to treat or prevent HIV infection. The HIV antibody is administered at a dose sufficient to promote viral clearance or eliminate HIV infected cells.

Also included in the invention is a method for determining the presence of an HIV virus infection in a patient, by contacting a biological sample obtained from the patient with an HIV antibody; detecting an amount of the antibody that binds to the biological sample; and comparing the amount of antibody that binds to the biological sample to a control value.

The invention further provides a diagnostic kit which may comprise an HIV monoclonal antibody.

The invention relates to a broadly neutralizing antibody (bNAb) wherein the antibody neutralizes at least one member of each clade with a potency greater than that of the bNAbs b12, 2G12, 2F5 and 4E10 respectively.

The invention relates to a broadly neutralizing antibody (bNAb) wherein the antibody binds or does not bind monomeric gp120 or gp41 proteins of the HIV-1 env gene. The antibody binds with higher affinity to trimeric forms of the HIV-1 Env expressed on a cell surface than to the monomeric gp120 or artificially trimerized gp140. In some aspects, the antibody binds with high affinity to uncleaved HIV-1 gp160 trimers on a cell surface.

The invention relates to a broadly neutralizing antibody (bNAb) wherein the antibody binds an epitope within the variable loop of gp120, wherein the epitope may comprise the conserved regions of V2 and V3 loops of gp120, wherein the epitope may comprise N-glycosylation site at residue Asn-160 within the V2 loop of gp120, wherein the antibody binds an epitope presented by a trimeric spike of gp120 on a cell surface, wherein the epitope is not presented when gp120 is artificially trimerized. In some embodiments, the antibody does not neutralize the HIV-1 in the absence of N-glycosylation site at residue Asn-160 within the V2 loop of gp120.

The invention relates to a broadly neutralizing antibody (bNAb) selected from the group consisting of PG16 and PG9. Moreover, the invention relates to a broadly neutralizing antibody (bNAb) selected from the group consisting of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496S09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158).

The invention relates to an antigen or an immunogenic polypeptide, or a vaccine which may comprise such antigen or immunogenic polypeptide, for producing a broadly neutralizing antibody (bNAb) by an immune response, the antigen which may comprise an epitope within the variable loop of gp120 according to the invention.

The invention relates to method for passive or active immunization of an individual against a plurality of HIV-1 species across one or more clades, the method which may comprise: providing a broadly neutralizing antibody (bNAb) wherein the bNAb neutralizes HIV-1 species belonging to two or more clades, and further wherein the potency of neutralization of at least one member of each clade is determined by an IC50 value of less than 0.005 µg/mL. In some embodiments, the antibody is selected from the group consisting of PG9 and PG16. Alternatively, or in addition, the antibody is selected from the group consisting of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158).

In some embodiments, the antibody is produced by active immunization with an antigen which may comprise an epitope within the variable loop of gp120, wherein the epitope may comprise the conserved regions of V2 and V3 loops of gp120 or, wherein the epitope may comprise an N-glycosylation site at residue Asn-160 within the V2 loop of gp120. In some aspects, the epitope is presented by a trimeric spike of gp120 on a cell surface, and the epitope is not presented when gp120 is monomeric or artificially trimerized.

The invention provides a method for obtaining a broadly neutralizing human monoclonal antibody, the method including: (a) screening memory B cell cultures from a donor PBMC sample for a broad neutralization activity against a plurality of HIV-1 species; (b) cloning a memory B cell that exhibits broad neutralization activity; and then (c) rescuing the monoclonal antibody from the clonal memory B cell culture that exhibits broad neutralization activity. In one embodiment the method, the screening step includes screening polyclonal transfectants for neutralization activity prior to the cloning step of monoclonal transfection. In this embodiment, the screening step is optionally repeated following monoclonal transfection. Finally, in this embodiment, the DNA sequence of the monoclonal antibody is determined as part of the rescue step. Exemplary antibodies that are generated using this embodiment include, but are not limited to, 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_1317 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_101 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158).

Alternatively, or in addition, the screening step includes determining variable gene sequences from selected B cell wells by deep sequencing, which is optionally followed by sequence alignment to cluster related antibodies. In this alternative embodiment, following the screening step, a monoclonal transfection is performed as part of the cloning step. Subsequently, in this alternative embodiment, monoclonal transfectants are screened for neutralization activity against an HIV virus from one or more clades. Exemplary antibodies that are generated using this embodiment include, but are not limited to, 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136 H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158).

Accordingly, it is an object of the invention to not encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1A is a schematic tree diagram of Clustal W-aligned variable region sequences of heavy chains of the monoclonal antibodies.

FIG. 1B is a schematic tree diagram of Clustal W-aligned variable region sequences of light chains of the monoclonal antibodies.

(PG16) and 1496_C09 (PG9) to HIV-1 YU2 gp140, JR-CSFgp120, membrane-proximal external regions (MPER) peptide of gp41 and V3 polypeptide.

Figure 7:
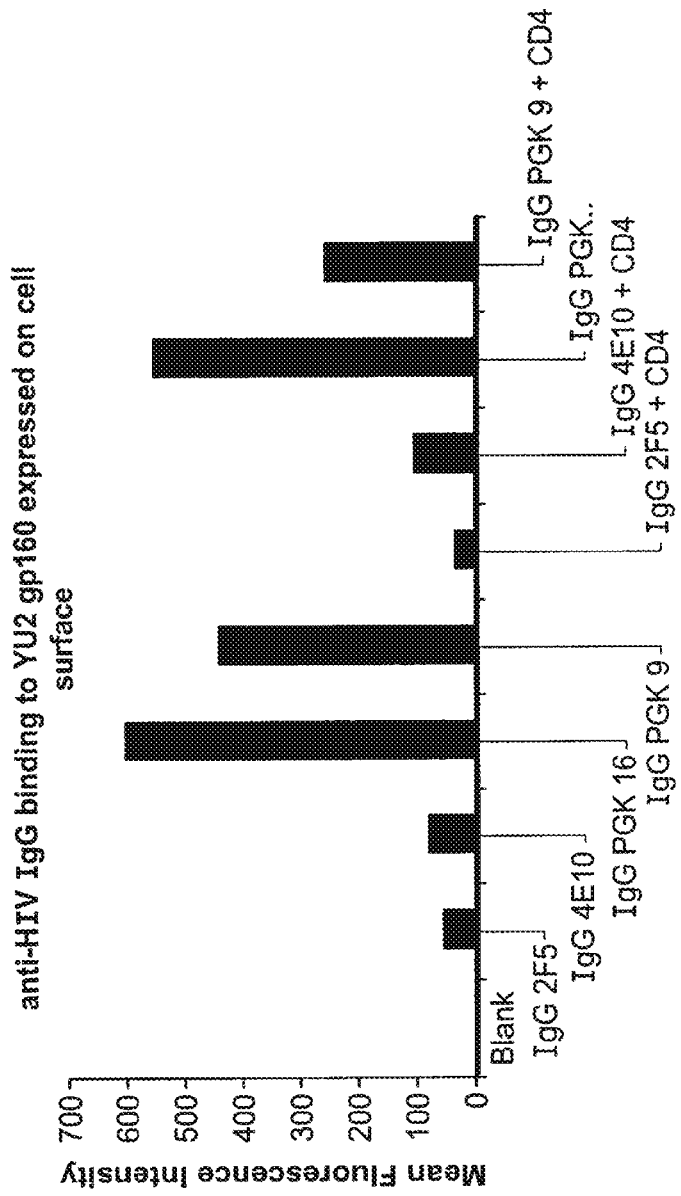

FIG. 7 is a graph depicting the results of a binding assay using monoclonal antibodies 1443_C16 (PG16) and 1496_C09 (PG9) to HIV-1 YU2 gp160 expressed on the cell surface in the presence and absence of soluble CD4 (sCD4).

Figure 8:
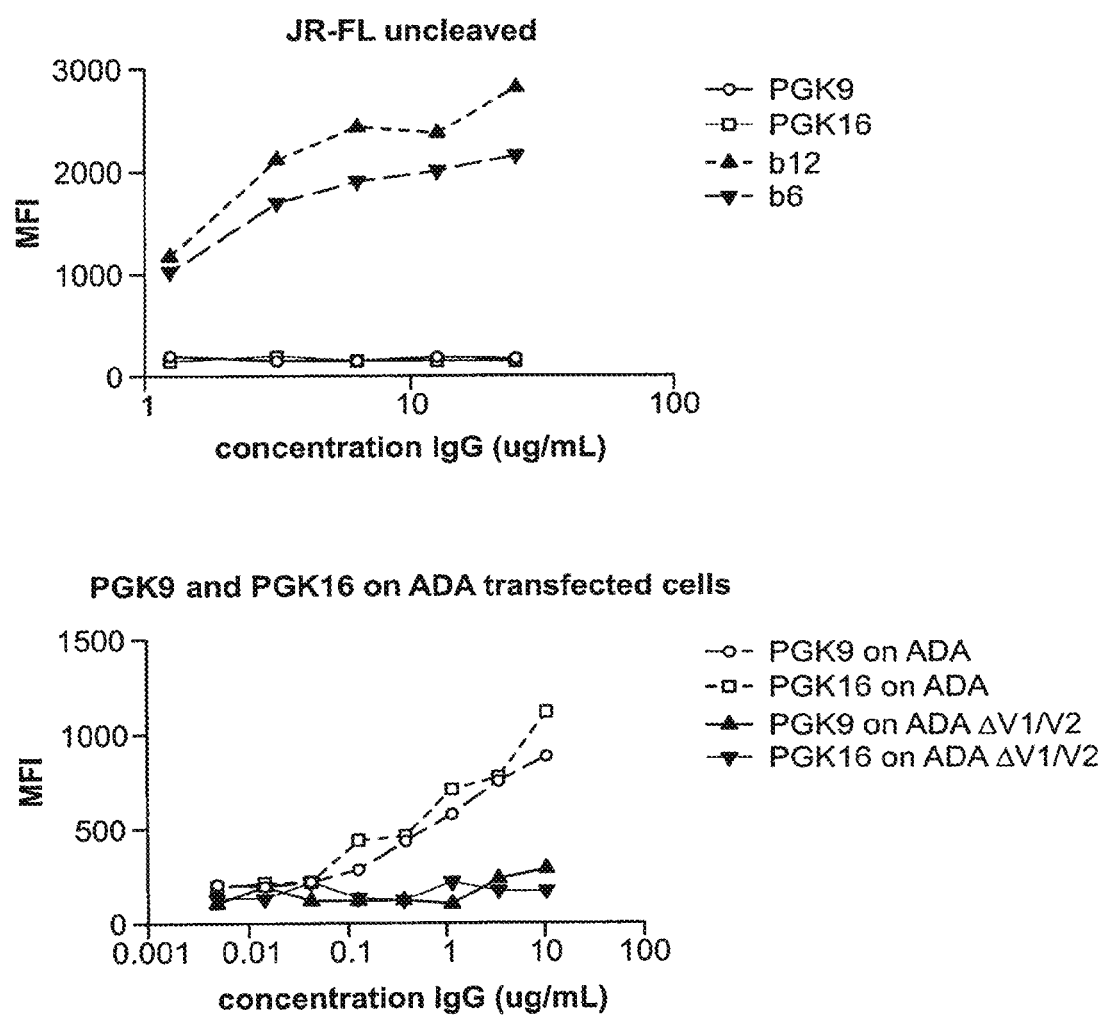
Figure 8:
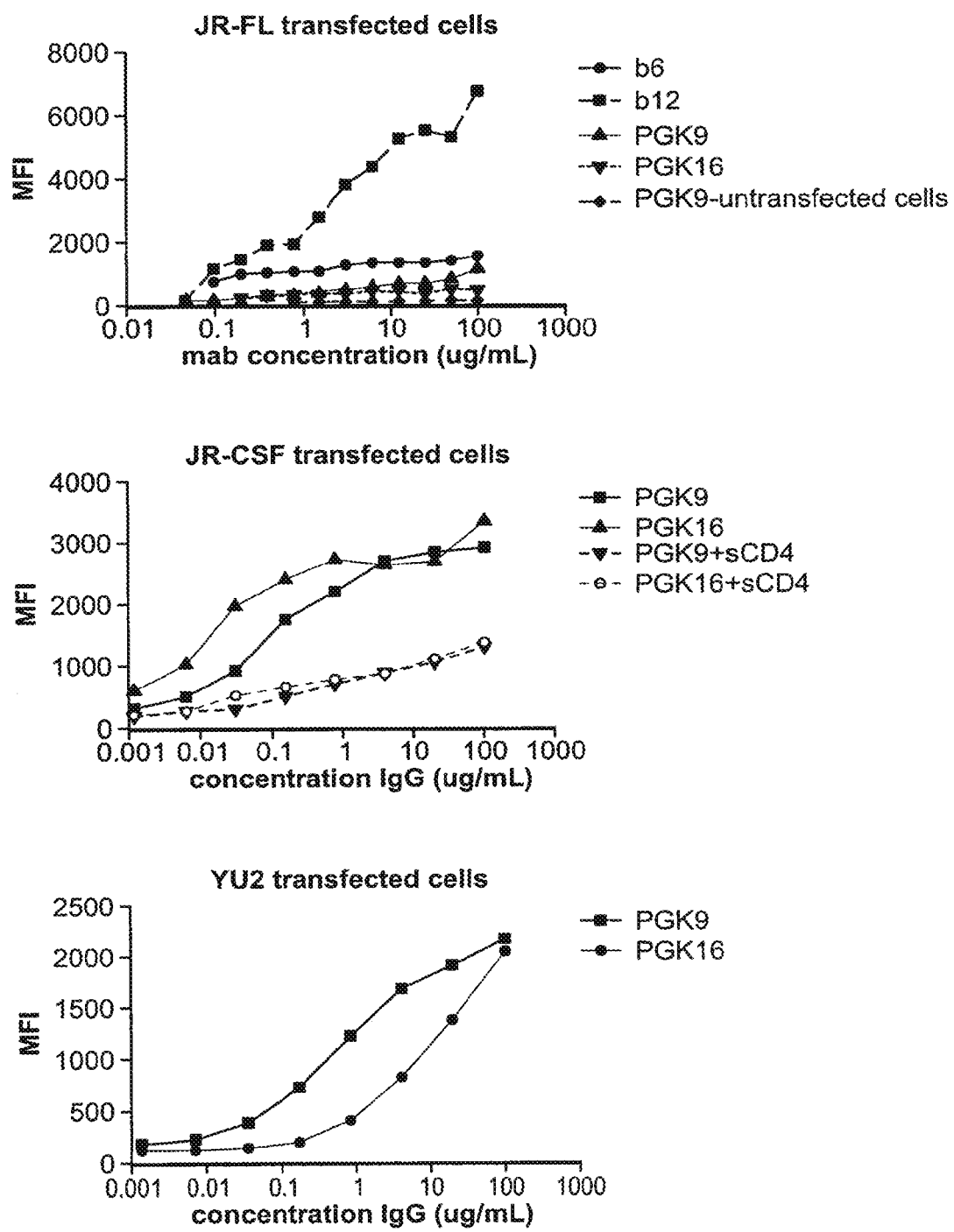

FIG. 8 is a graph depicting the results of a binding assay using monoclonal antibodies 1443_C16 (PG16) and 1496_C09 (PG9) to HIV-1 gp160 transfected cells.

Figure 9:
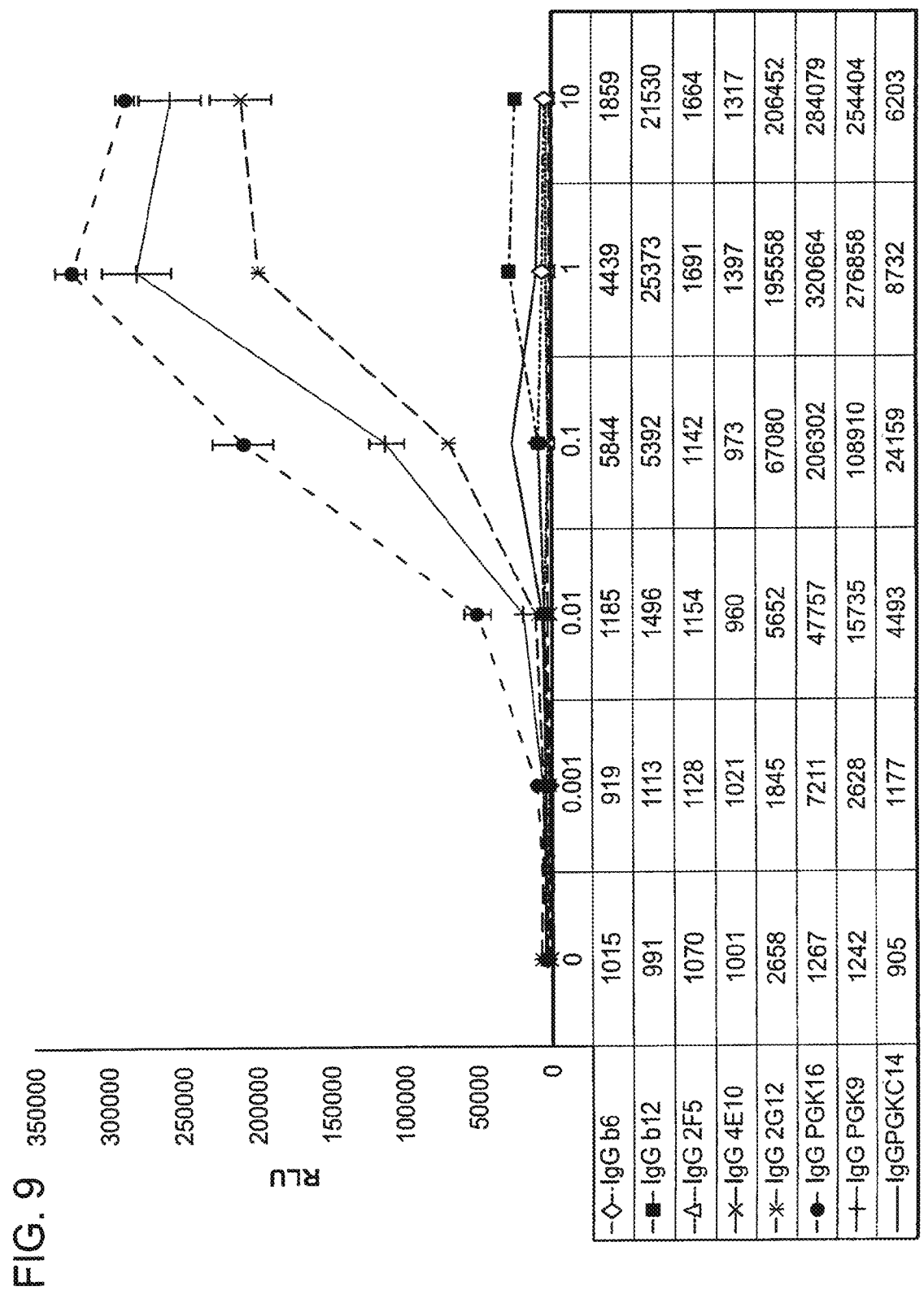

FIG. 9 is a series of graphs depicting the results of a capture assay. The data describe capturing of entry-competent JRCSF pseudovirus by neutralizing monoclonal antibodies 1443_C16 (PG16) and 1496_C09 (PG9) in a dose-dependent manner.

Figure 10A:
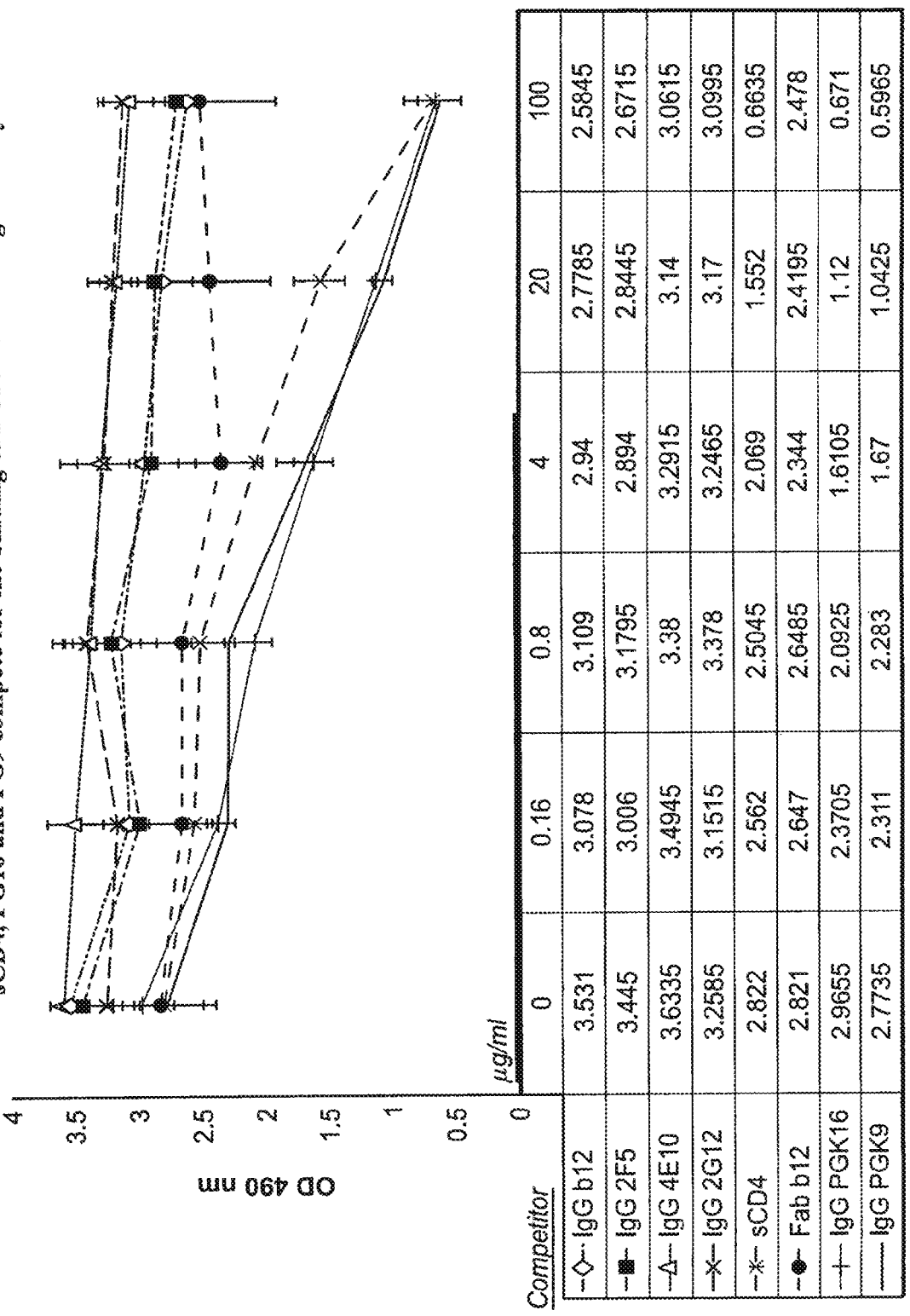

FIG. 10A is a graph depicting the results of a competitive binding assay using monoclonal antibodies sCD4, PG16 and PG9, wherein the claimed antibodies compete for the binding of monoclonal antibody 1443_C16 (PG16) to pseudovirus but control antibodies b12, 2G12, 2F5 and 4E10 do not competitively bind to the pseudovirus.

Figure 10B:
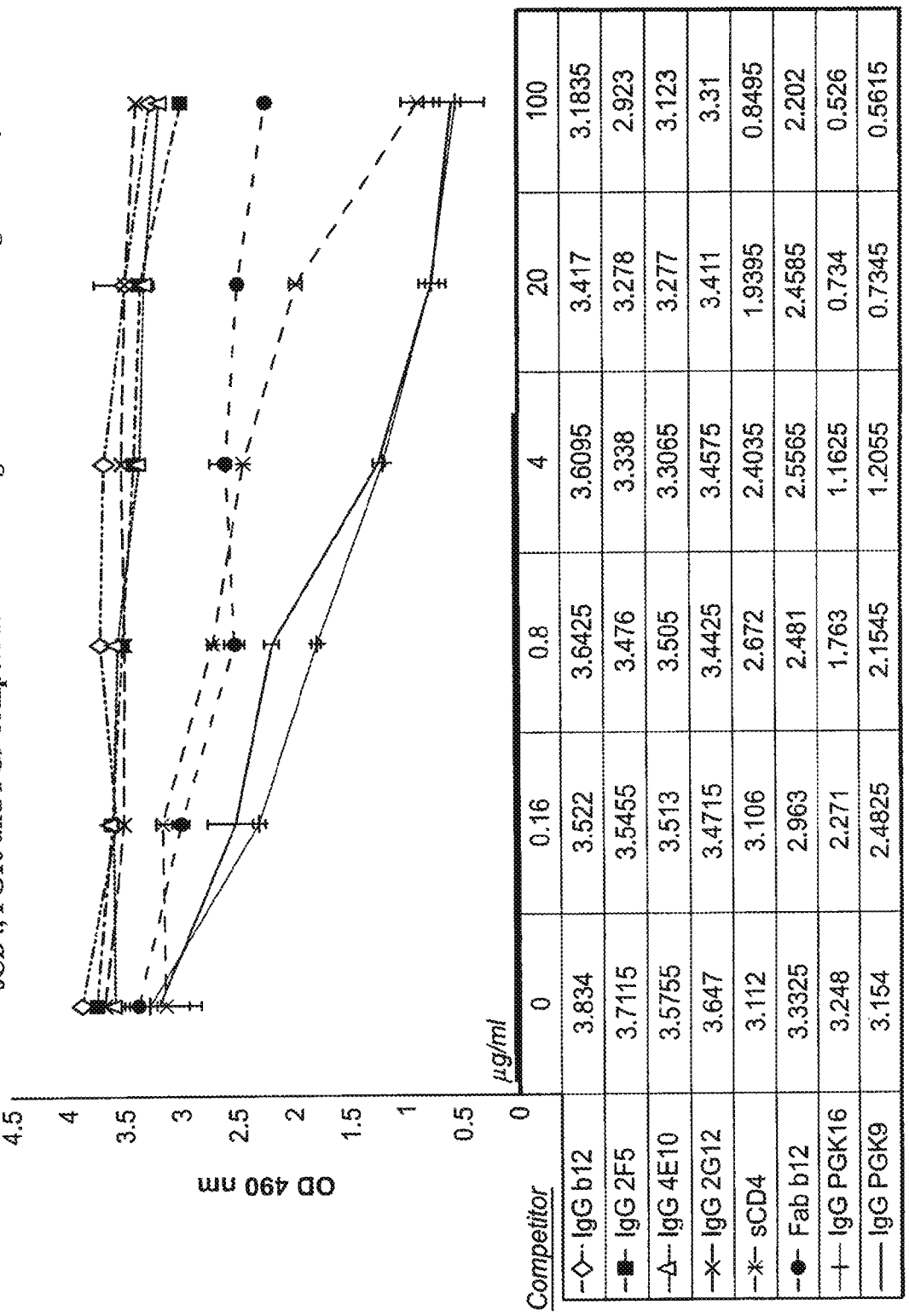

FIG. 10B is a graph depicting the results of a competitive binding assay using monoclonal antibodies sCD4, PG16 and PG9, wherein the claimed antibodies compete for the binding of monoclonal antibody 1496_C09 (PG9) to pseudovirus but control antibodies b12, 2G12, 2F5 and 4E10 do not competitively bind to the pseudovirus.

Figure 11A:
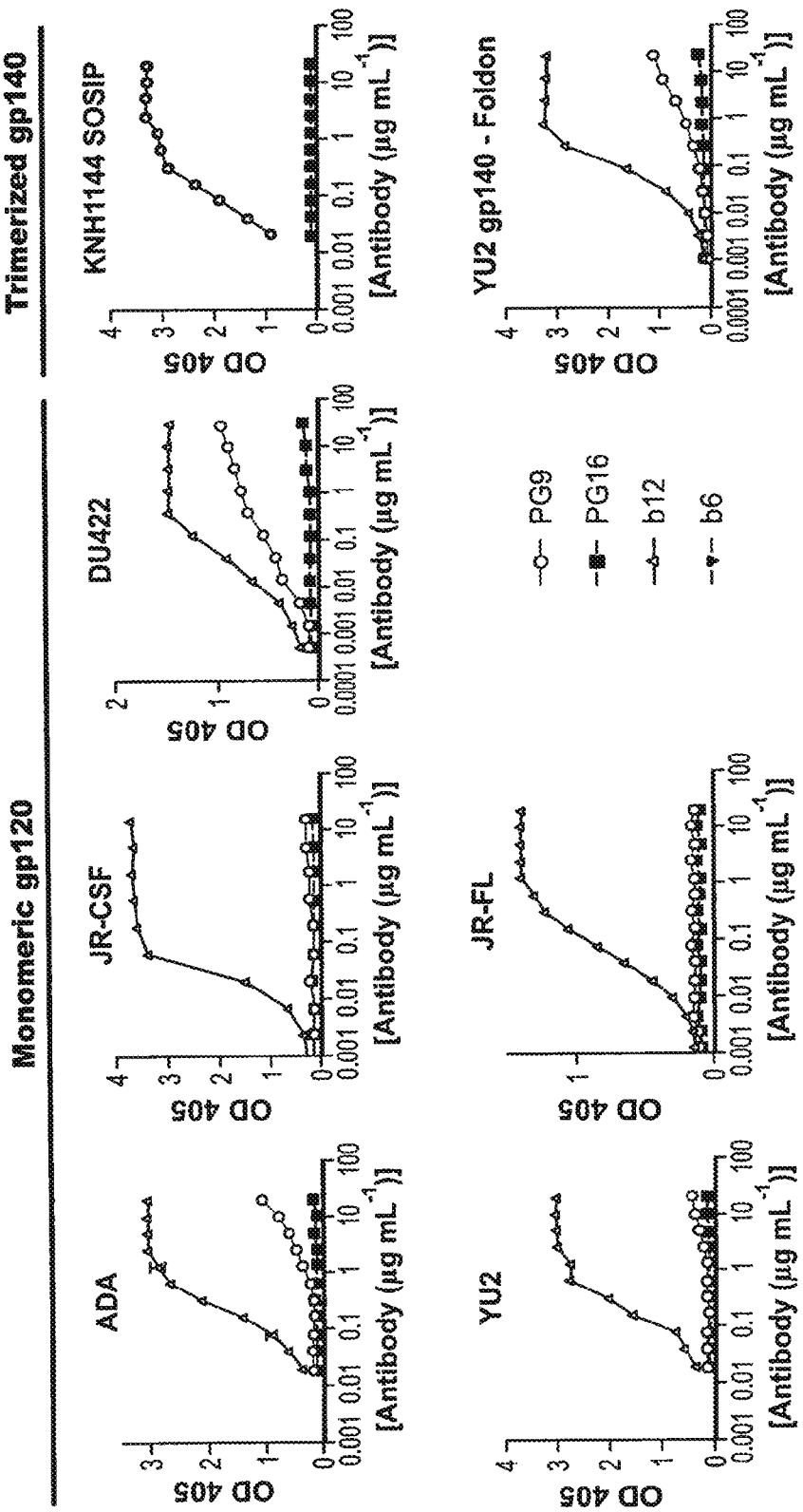

FIG. 11A is a series of graphs depicting the results of a binding assay using PG9 and PG16. The data show that PG9 and PG16 bind to monomeric gp120 and artificially trimerized gp140 constructs as determined by ELISA. IgG b12 was used as a control for ELISA assays.

Figure 11B:
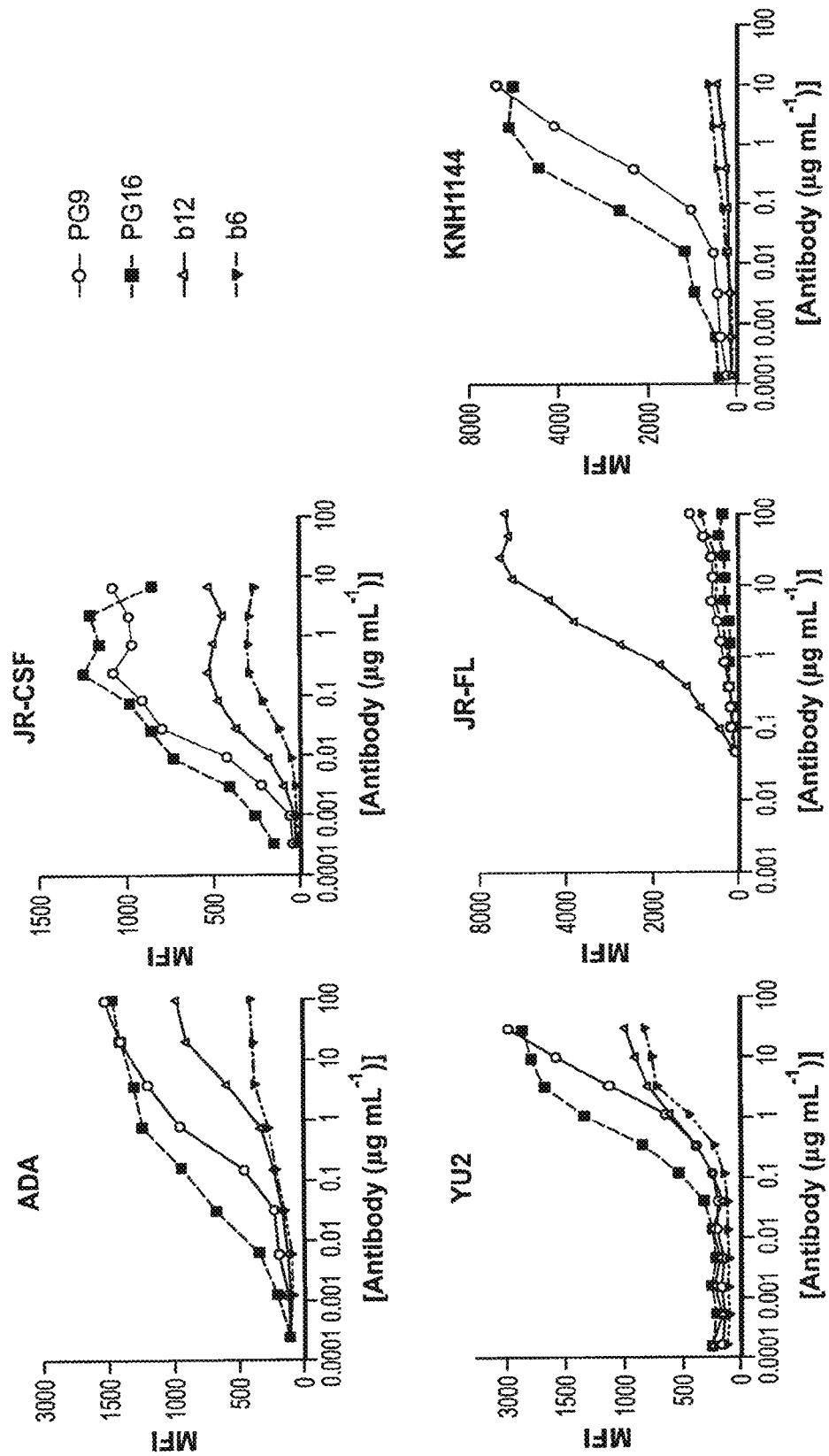

FIG. 11B is a series of graphs depicting the results of a binding assay using PG9 and PG16. The data show that PG9 and PG16 bind to Env expressed on the surface of 293T cells as determined by flow cytometry. The bNAb b12 and the non-neutralizing antibody b6 are included in the cell surface binding assays to show the expected percentages of cleaved and uncleaved Env expressed on the cell surface.

Figure 12:
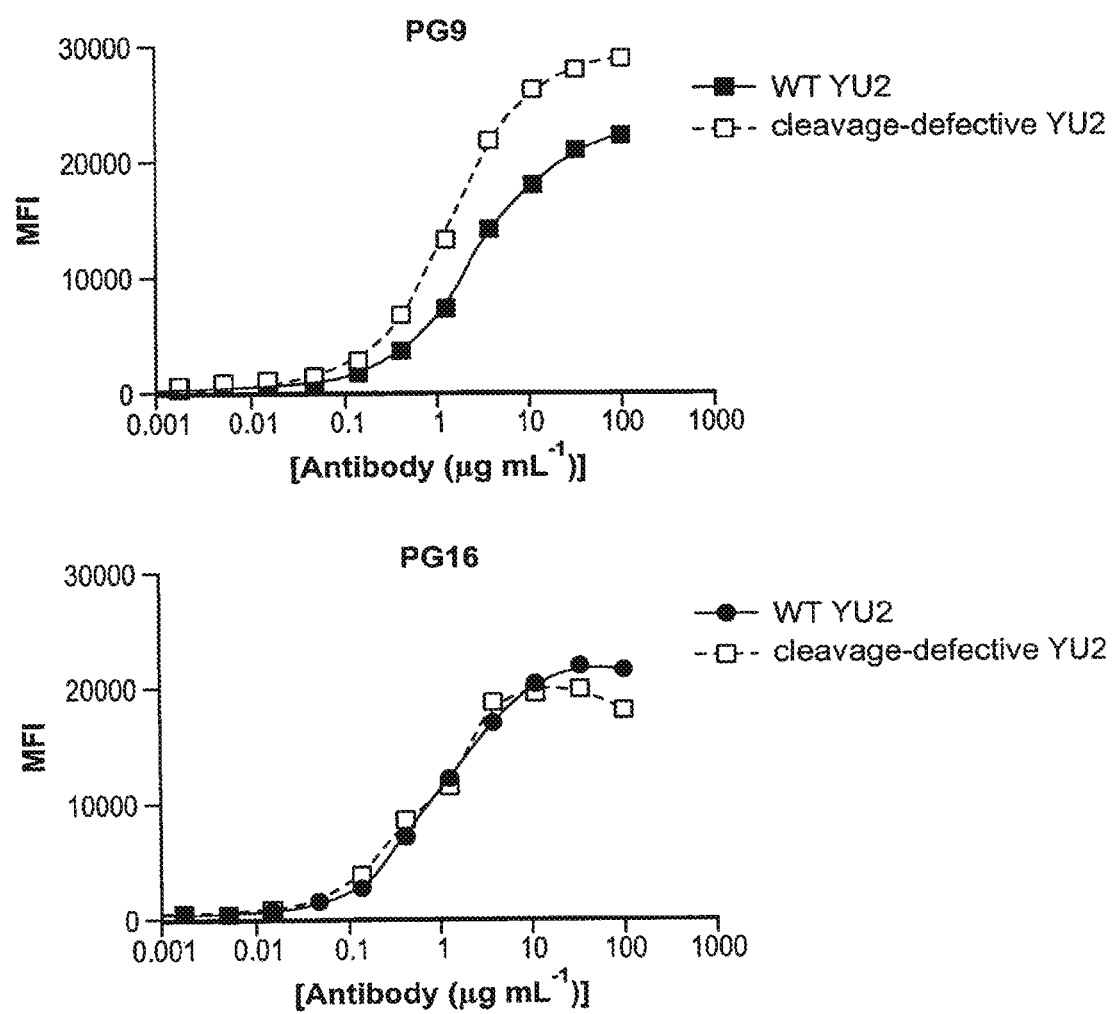

FIG. 12 is a series of graphs depicting the results of a binding assay using PG9 and PG16 and cleavage-defective HIV-1YU2 trimers. PG9 and PG16 bind with high affinity to cleavage-defective HIV-1YU2 trimers as determined by flow cytometry. Binding curves were generated by plotting the MFI of antigen binding as a function of antibody concentration.

FIG. 13A-13E is a series of graphs depicting the mapping the PG9 and PG16 epitopes. Competitor antibody is indicated at the top of each graph. 2G12 is included to control for cell surface Env expression. A: PG9 and PG16 compete with each other for cell surface Env binding and neither antibody competes with the CD4bs antibody b12 for Env binding. B: Ligation of cell surface Env with sCD4 diminishes binding of PG9 and PG16. 2G12 is included to control for CD4-induced shedding of gp120. C: sCD4 inhibits binding of PG9 to artificially trimerized gp140YU-2 as determined by ELISA. D: PG9 competes with 10/76b (anti-V2), F425/b4e8 (anti-V3) and X5 (CD4i) for gp120 binding in competition ELISA assays. E: PG9 and PG16 fail to bind variable loop deleted HIV-1JR-CSF variants expressed on the surface of 293T cells.

Figure 14:
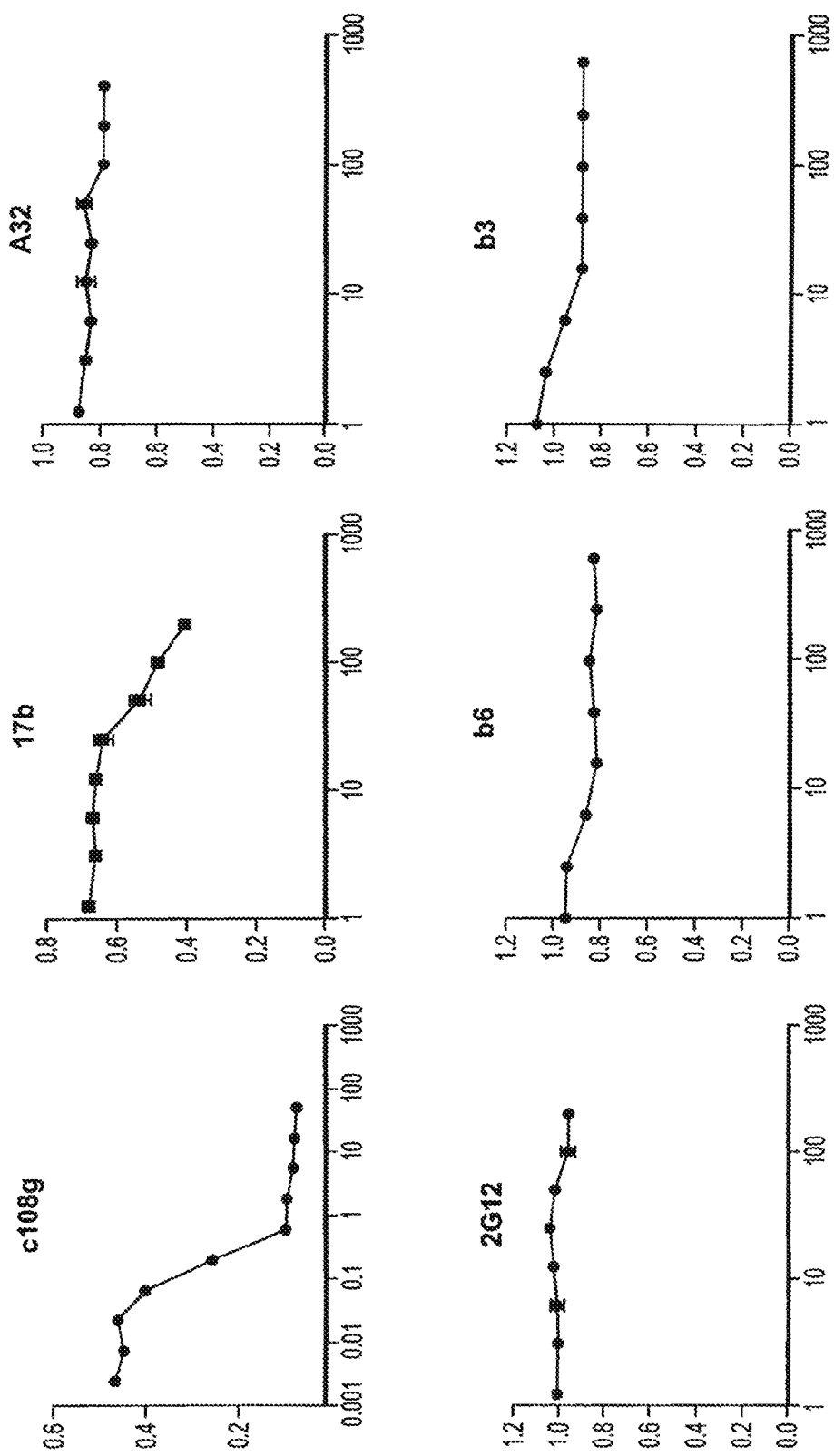

FIG. 14 is a series of graphs depicting the results of competition ELISA assays using the monoclonal antibody PG9.

Figure 15:
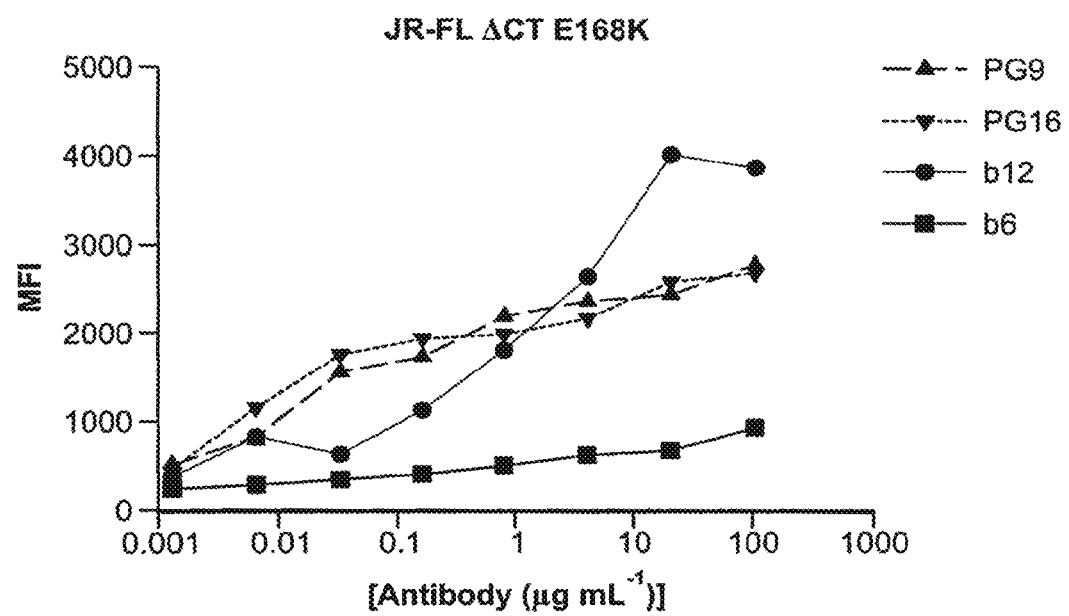

FIG. 15 is a graph depicting monoclonal antibody binding, PG9 or PG16, to HIV-IJR-FLΔCT E168K Env expressed on the surface of 293T cells as determined by flow cytometry.

Figure 16:
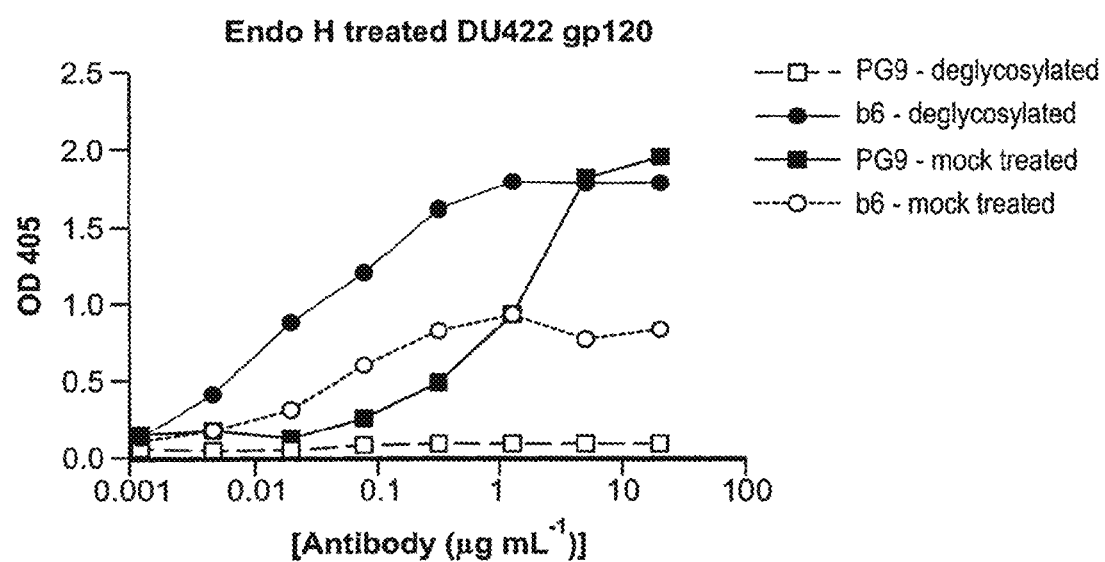

FIG. 16 is a graph depicting monoclonal antibody PG9 binding to deglycosylated gp120.

Figure 17:
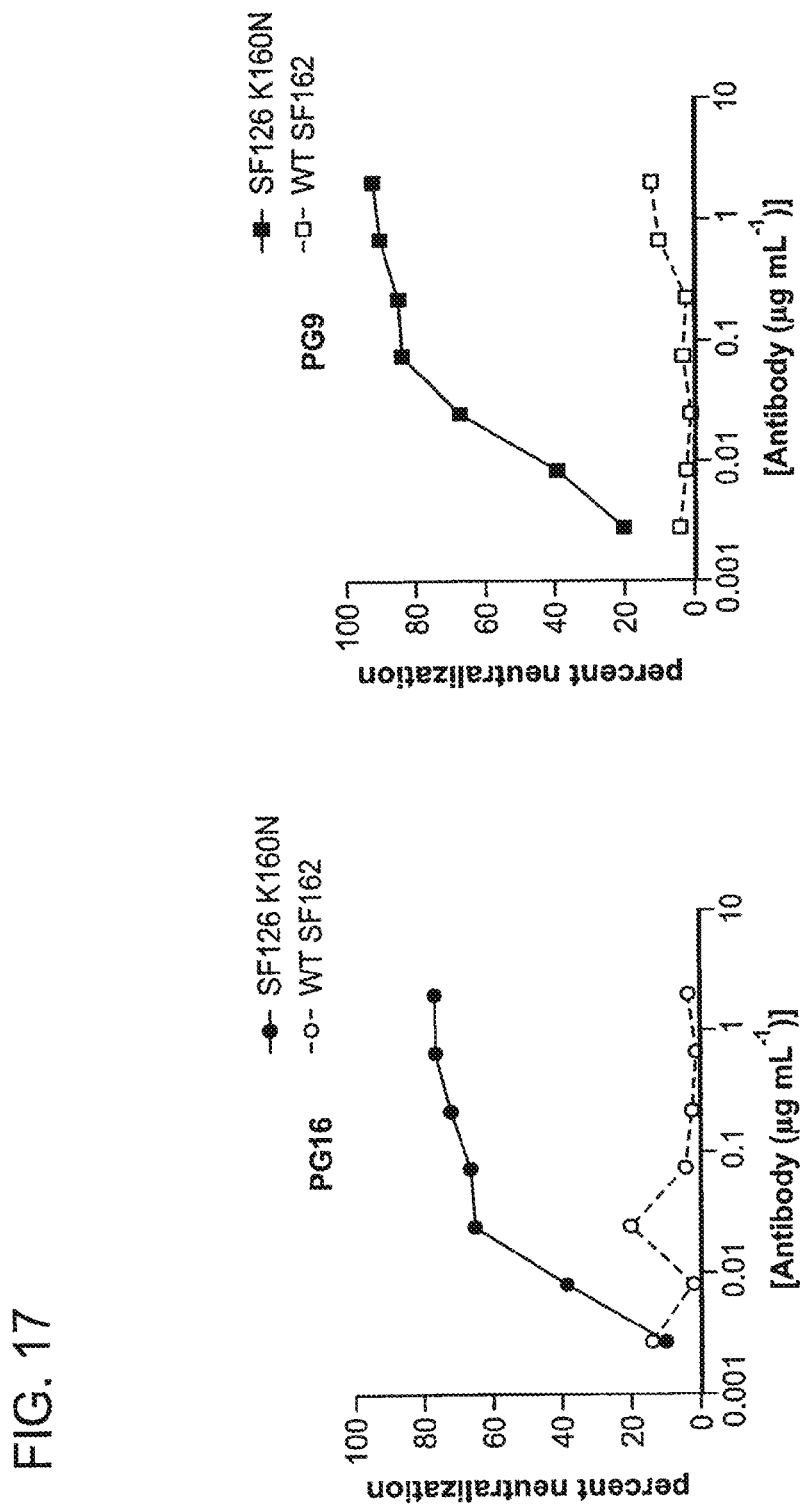

FIG. 17 is a series of graphs depicting the neutralization activity of PG9 and PG16 against HIV-1SF162 and HIV-1SF162 K160N, which was determined using a single-round replication luciferase reporter assay of pseudotyped virus.

Figure 18:
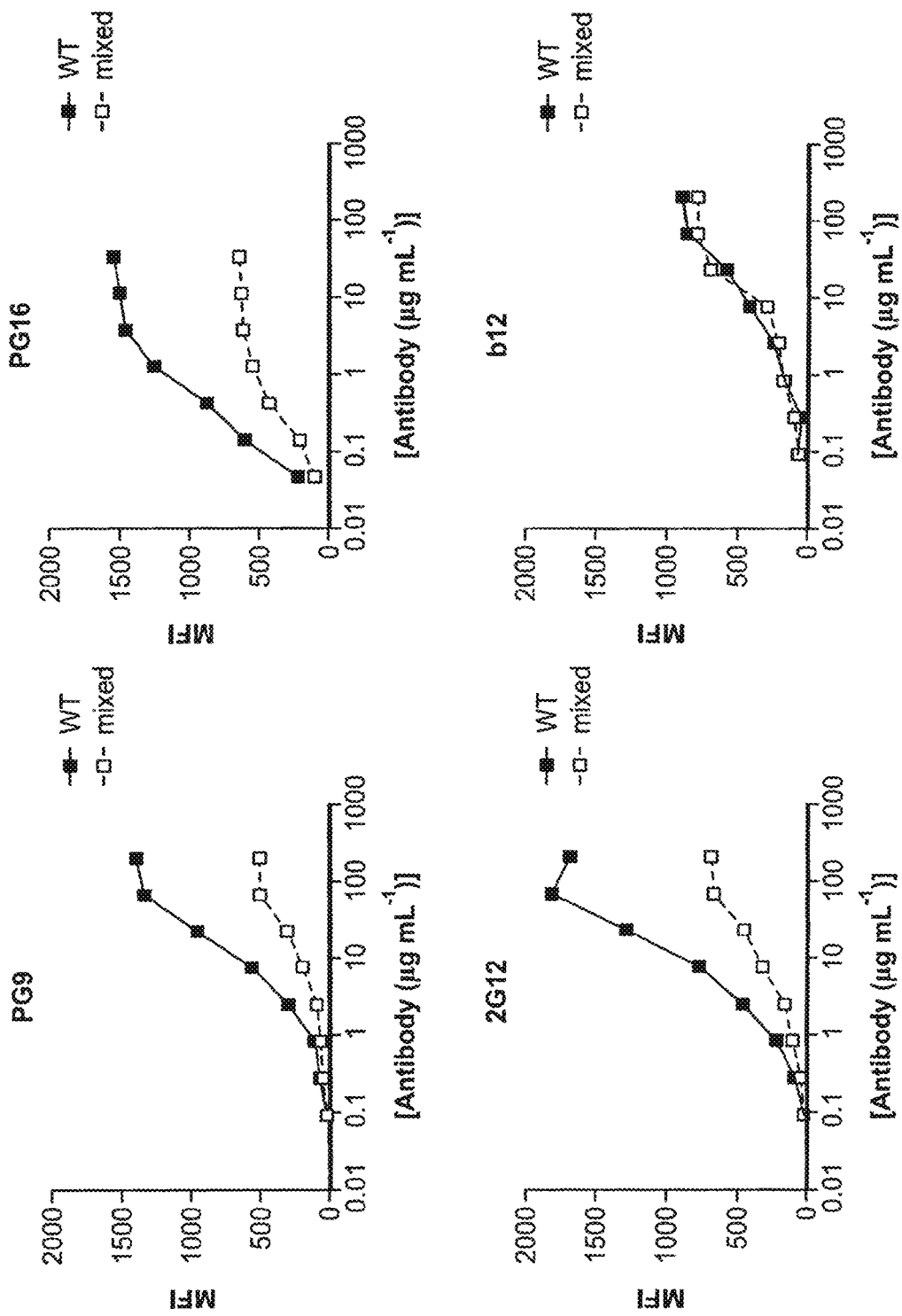

FIG. 18 is a series of graphs depicting the binding of PG9 and PG16 to mixed trimers. Alanine substitutions at positions 160 and 299 were introduced into HIV-1YU2 Env to abolish binding of PG9 and PG16. An alanine substitution at position 295 was also introduced into the same construct to abrogate binding of 2G12. Co-transfection of 293T cells with WT and mutant plasmids in a 1:2 ratio resulted in the expression of 29% mutant homotrimers, 44% heterotrimers with two mutant subunits, 23% heterotrimers with one mutant subunit, and 4% wild-type homotrimers.

Figure 19:
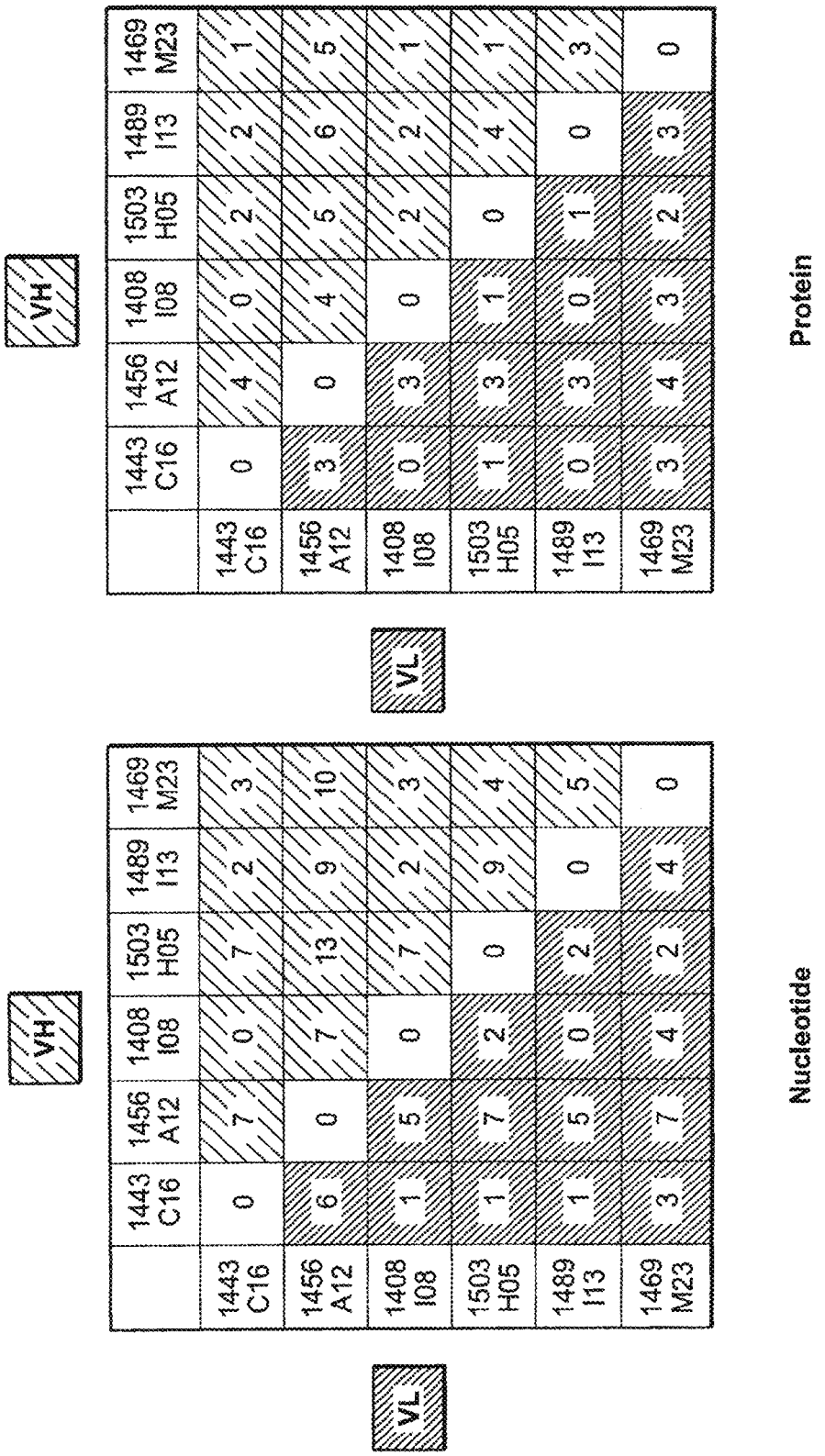

FIG. 19 is a series of graphical depictions of the number of nucleotide or amino acid differences in the heavy chain sequences of sister clones of 1443_C16 (PG16) among each other. Note that the single nucleotide difference of 1408 108 translates into an identical protein sequence of 1443_C16. The nucleotide sequence of the 1408 108 light chain is identical to the nucleotide sequence of the light chain of 1443_C16.

FIG. 20A is a tree diagram illustrating the correlation of the heavy chain of 1443_C16 sister clones to the heavy chain of 1496 C09 at the nucleotide level.

FIG. 20B is a tree diagram illustrating the correlation of the light chain of 1443_C16 sister clones to the light chain of 1496 C09 at the nucleotide level.

Figure 21A:
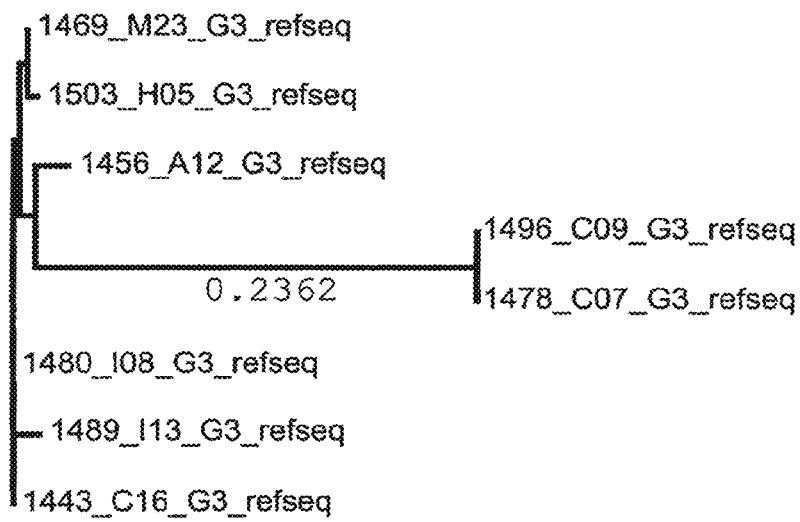

FIG. 21A is a tree diagram illustrating the correlation of the heavy chain of 1443_C16 sister clones to the heavy chain of 1496 C09 at the protein level.

Figure 21B:
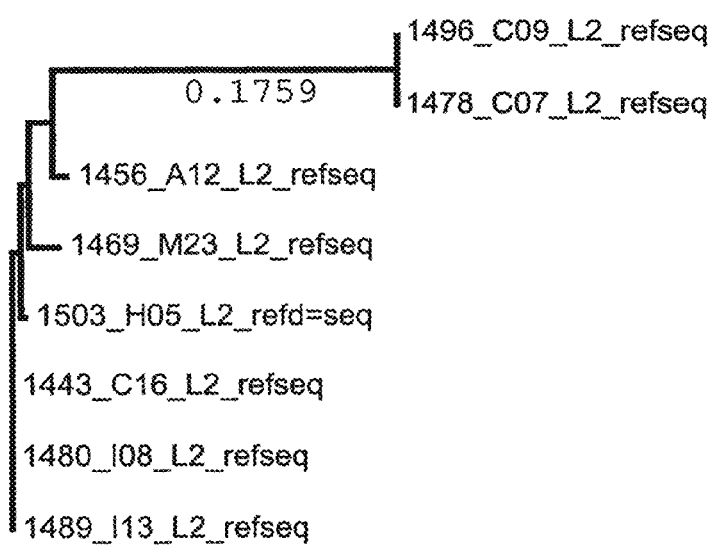

FIG. 21B is a tree diagram illustrating the correlation of the light chain of 1443_C16 sister clones to the light chain of 1496 C09 at the protein level.

Figure 22:
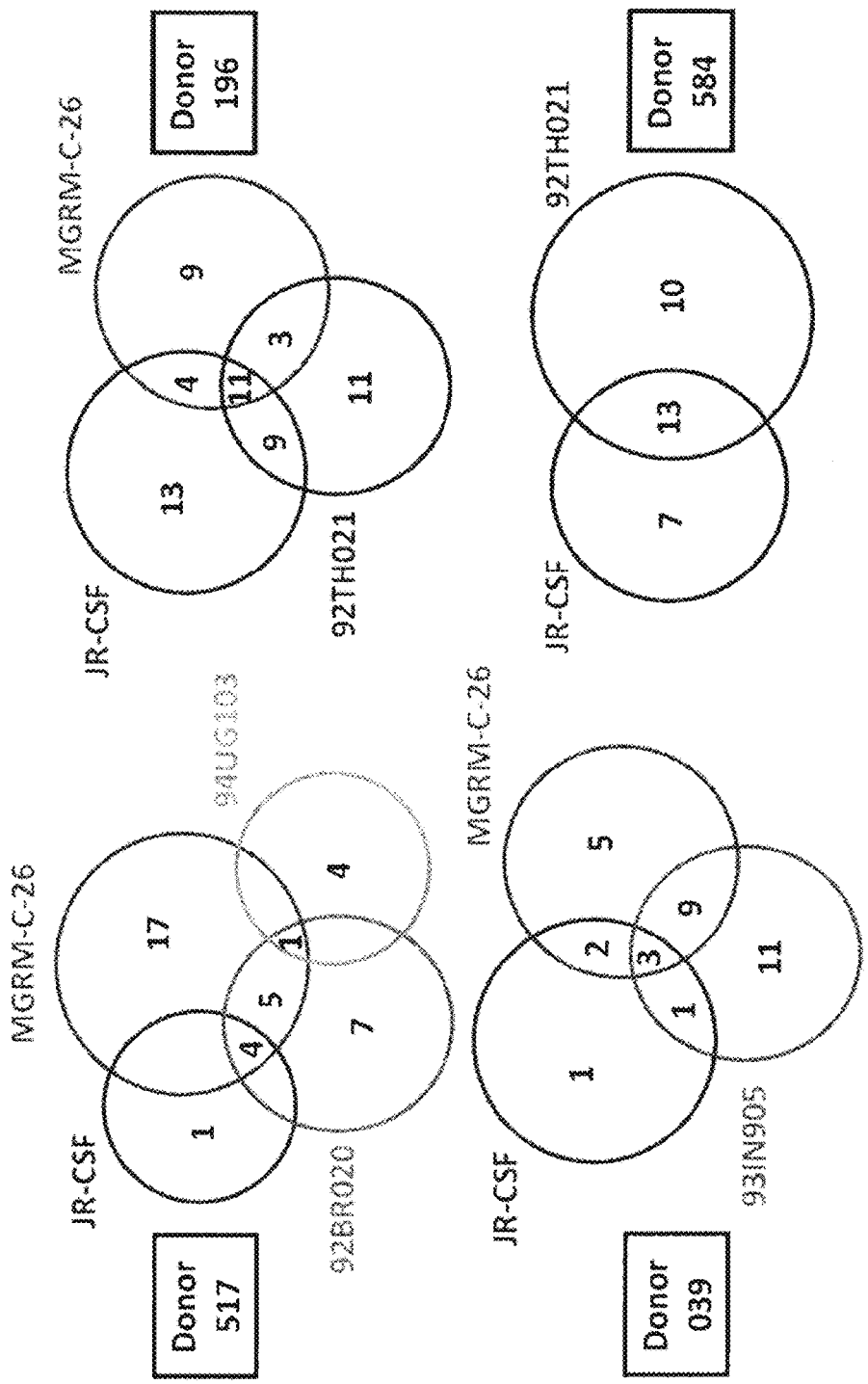

FIG. 22 is a Venn diagram depicting the viruses used in primary HIV-neutralization screening (JR-CSF, MGRM-C-26, 92BR020, 94UG103, 93IN905, 92TH021) and the number of neutralizing antibodies identified using these viruses alone, or in the demonstrated combinations. The results of screening antibodies isolated from B-cell cultures established from four human donors (#517, 039, 196, and 584) are shown.

Figure 23:
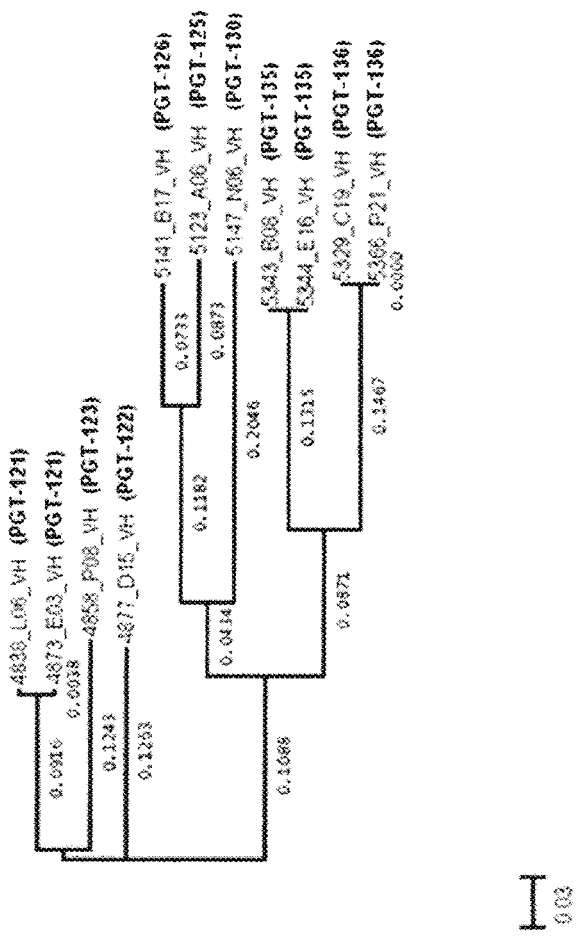

FIG. 23 is a tree diagram illustrating the relationships between the heavy chain variable gene sequences of antibodies PGT-121, PGT-122, PGT-123, PGT-125, PGT-126, PGT-130, PGT-135, and PGT-136. Scale bar=0.03. A value of zero demonstrates that an identical antibody was produced by two separate B-cell clones. Antibodies are less closely-related as the provided values increase.

Figure 24:
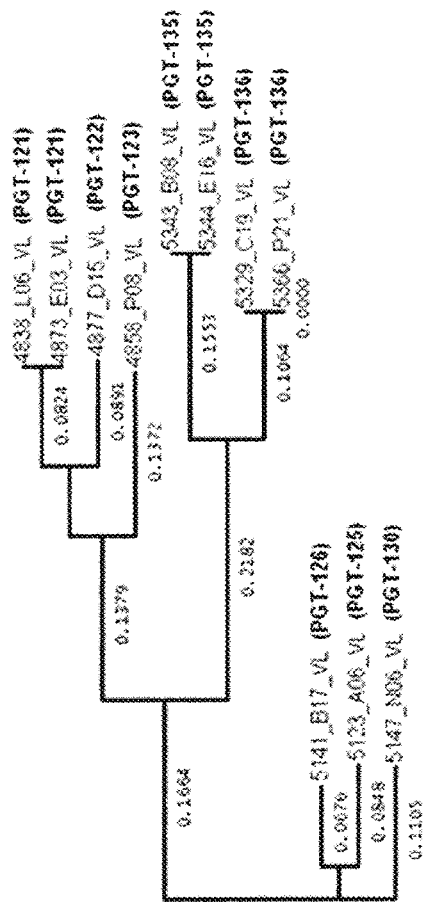

FIG. 24 is a tree diagram illustrating the relationships between the light chain variable gene sequences of antibodies PGT-121, PGT-122, PGT-123, PGT-125, PGT-126, PGT-130, PGT-135, and PGT-136. Scale bar=0.04. A value of zero demonstrates that an identical antibody was produced by two separate B-cell clones. Antibodies are less closely-related as the provided values increase.

Figure 25:
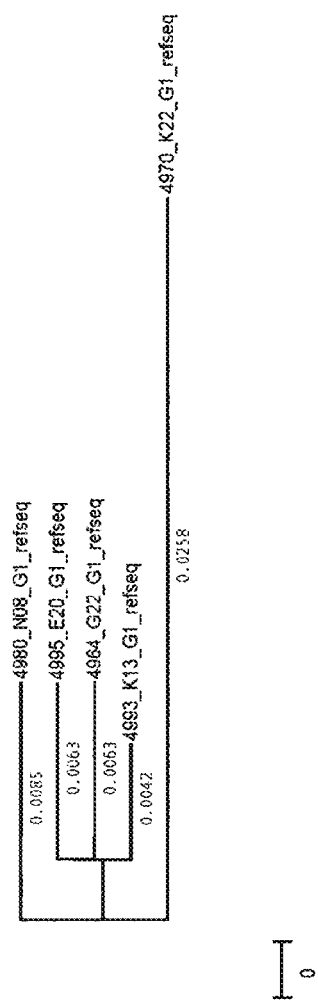

FIG. 25 is a tree diagram illustrating the relationships between the heavy chain variable gene sequences of antibodies PGT-141, PGT-142, and PGT-143. Scale bar=0.04. A value of zero demonstrates that an identical antibody was produced by two separate B-cell clones. Antibodies are less closely-related as the provided values increase.

Figure 26:
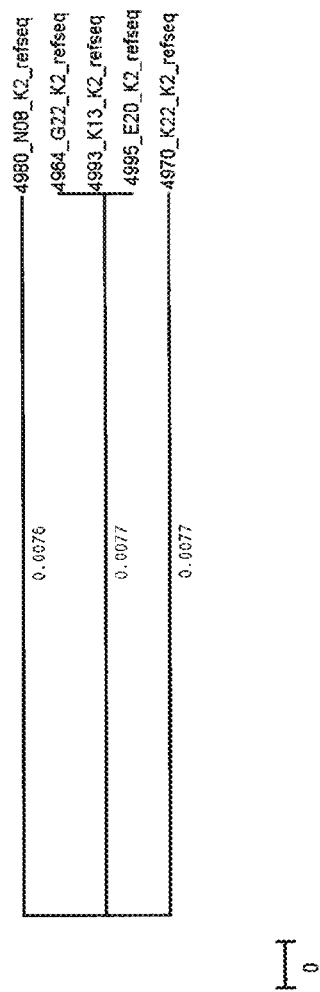

FIG. 26 is a tree diagram illustrating the relationships between the light chain variable gene sequences of antibodies PGT-141, PGT-142, and PGT-143. Scale bar=0.04. A value of zero demonstrates that an identical antibody was produced by two separate B-cell clones. Antibodies are less closely-related as the provided values increase.

Figure 27:
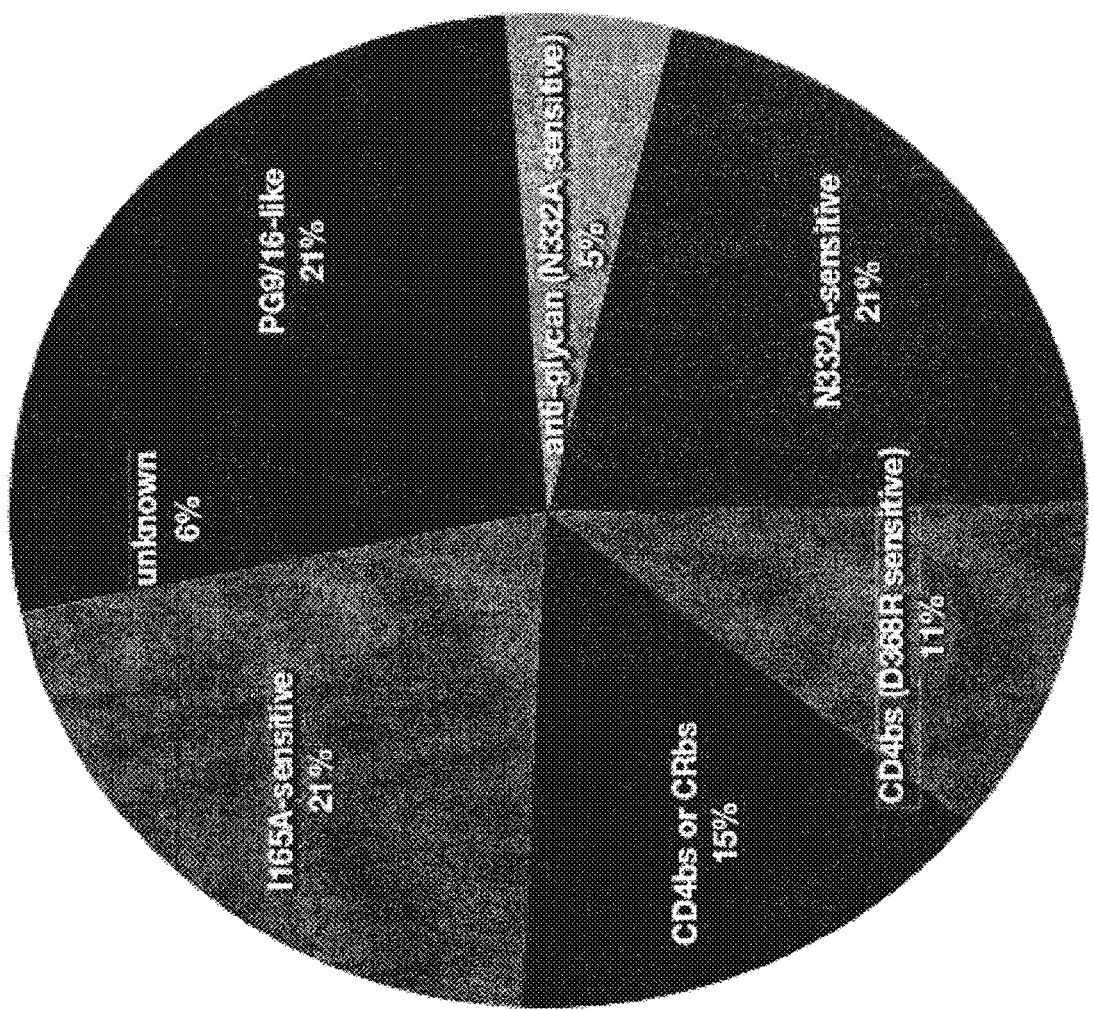

FIG. 27 is a pie chart showing that a limited number of antibody specificities mediate broad and potent serum neutralization in elite neutralizers (Walker L M, et al. PLOS Pathogen, 2010).

Figure 28:
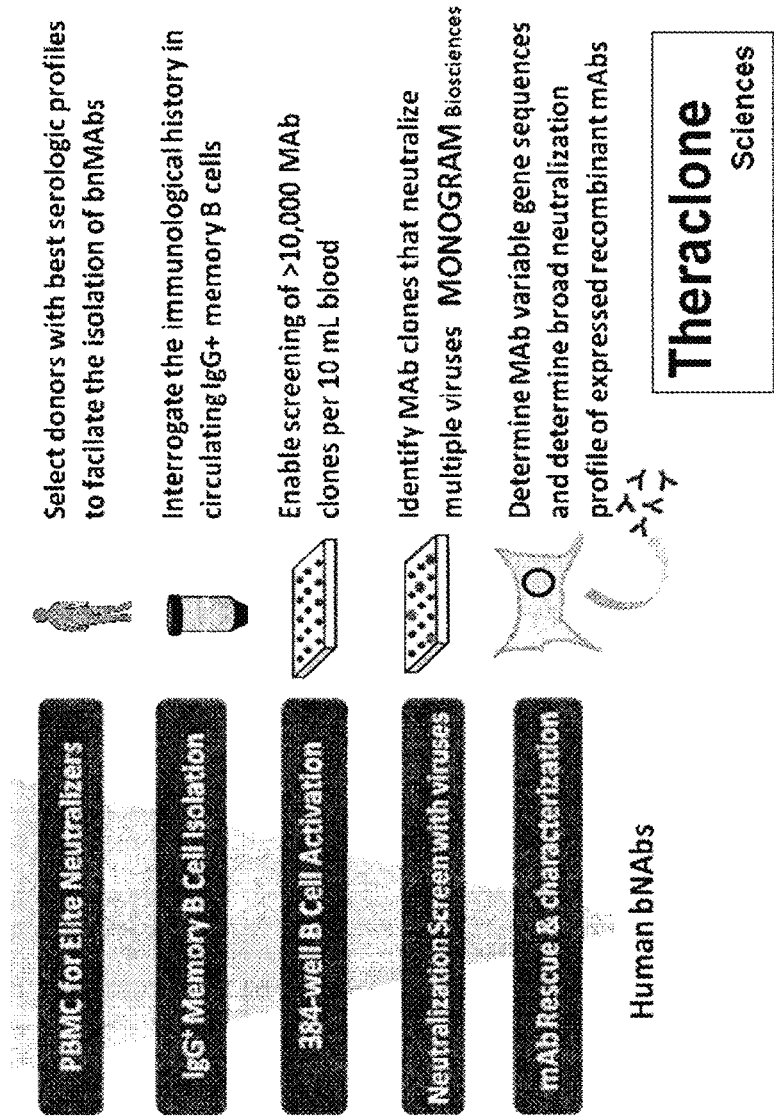

FIG. 28 is a schematic diagram depicting the I-Star™ Human bNAb (broadly Neutralizing Antibody) Discovery Platform developed by Theraclone Sciences.

Figure 29:
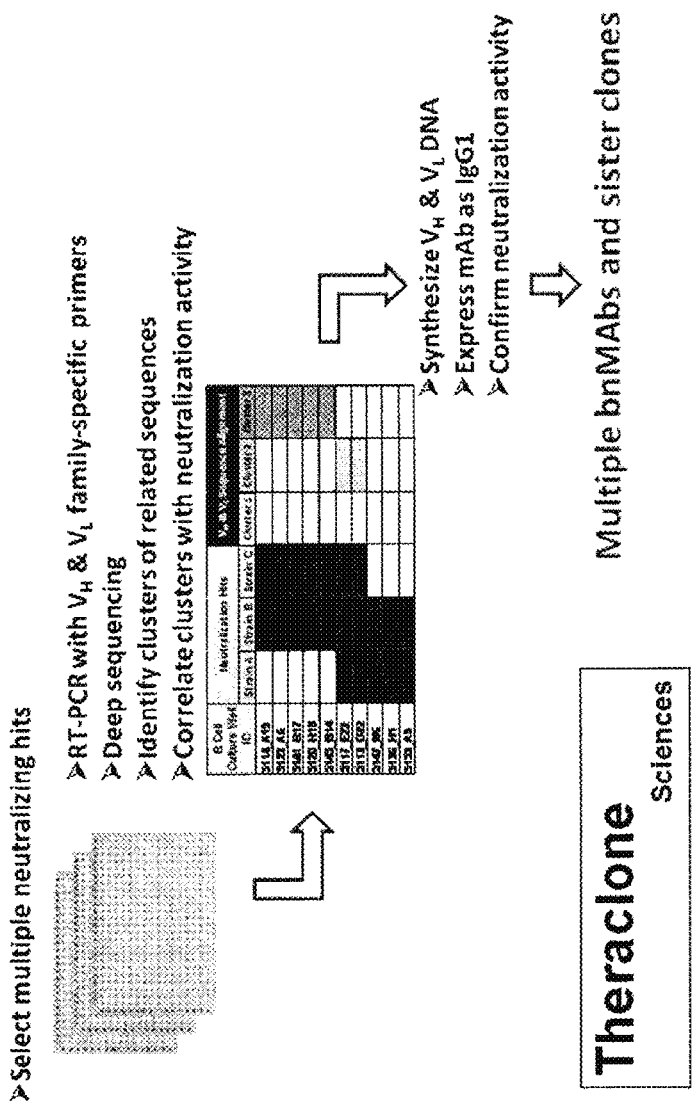

FIG. 29 is a schematic diagram depicting the method of bNMab (broadly Neutralizing Monoclonal Antibody) isolation form IgG-positive (IgG$^+$) Memory B Cells developed by Theraclone Sciences.

Figure 30:
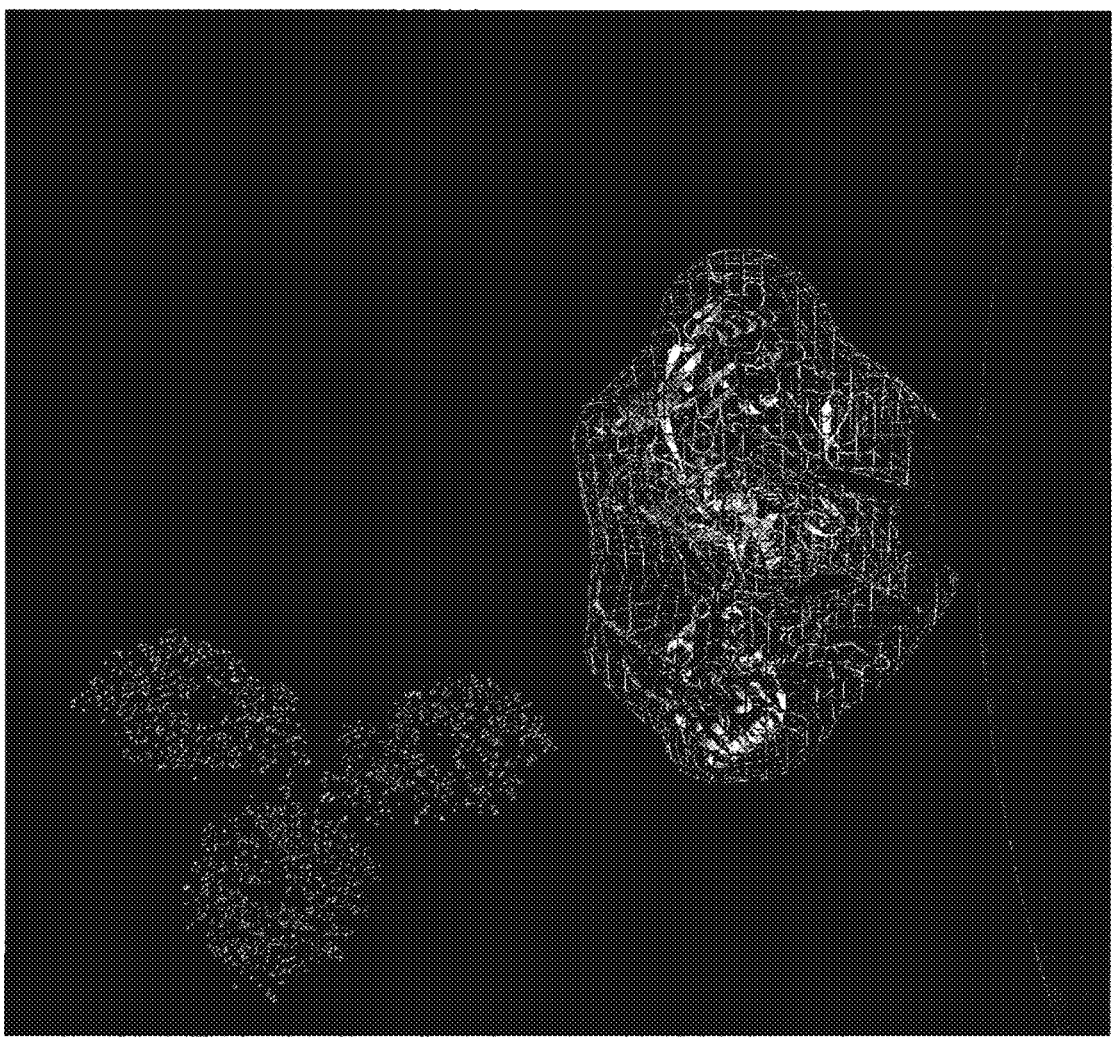

FIG. 30 is a computer-generated three-dimensional depiction of trimer-specific PG9 and PG16 antibodies in close proximity of conserved regions of V2 and V3, where they bind.

Figure 31:
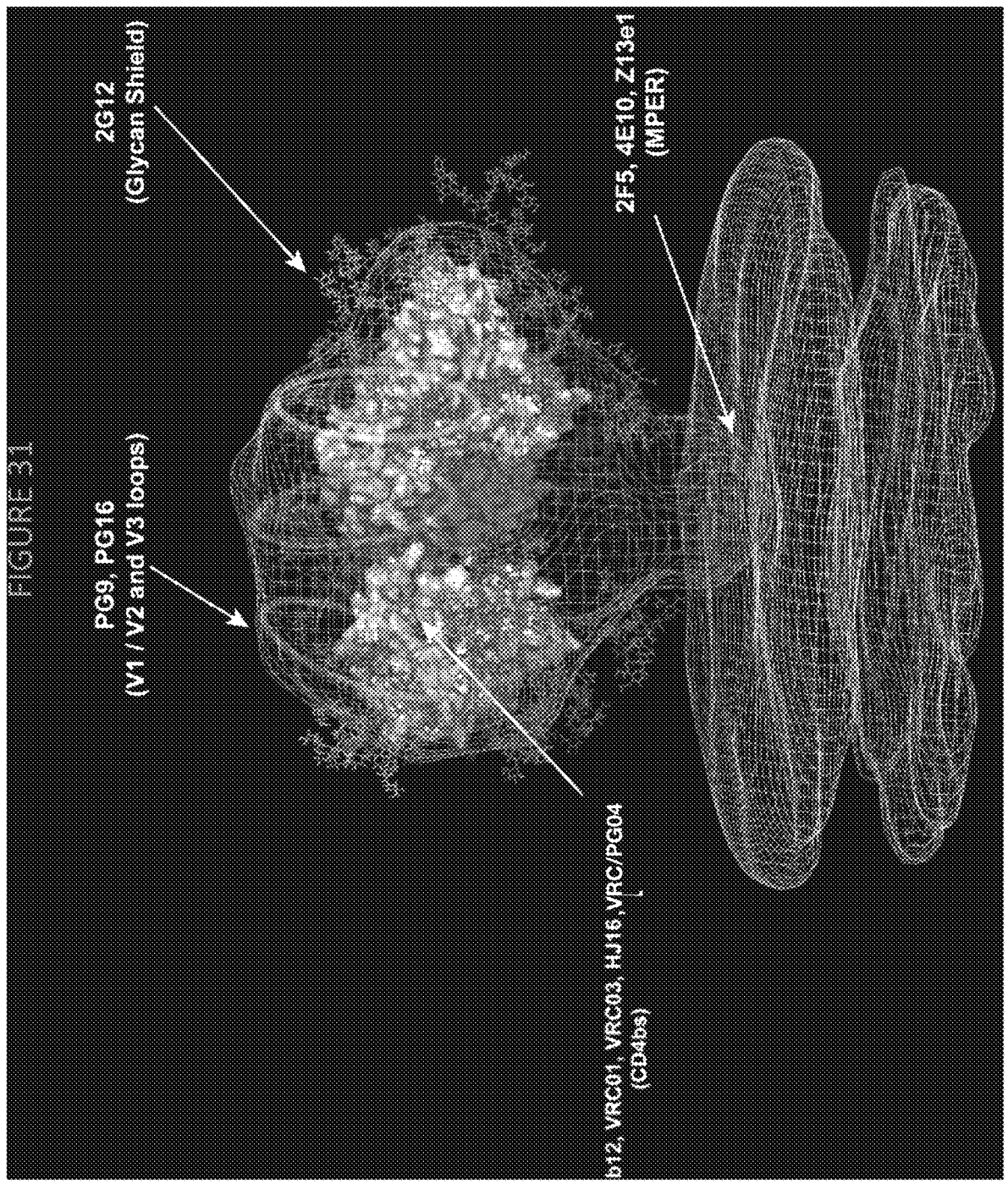

FIG. 31 is a computer-generated three-dimensional depiction of highly conserved epitopes on the HIV spike, including the V1/V2 and V3 loops to which PG9 and PG16 bind and the epitopes to which PGT-121, PGT-122, PGT-123, PGT-125, PGT-126, PGT-130, PGT-135, PGT-136, PGT-141, PGT-142, PGT-143, and PGT-144.

Figure 32:
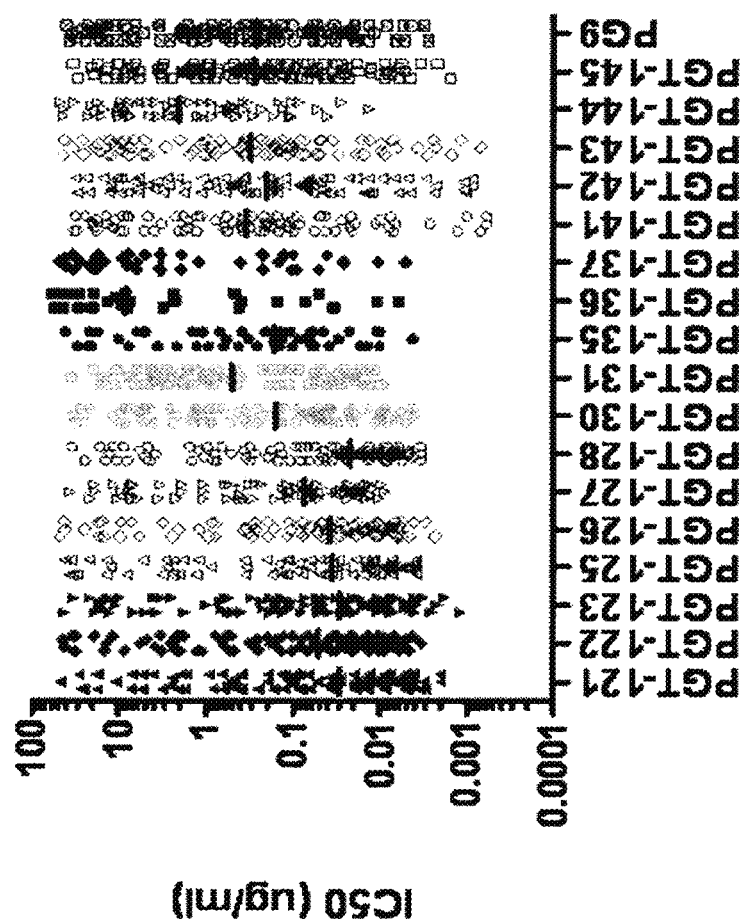

FIG. 32 is a graph depicting the potency of monoclonal anti-HIV antibodies PGT-121, PGT-122, PGT-123, PGT-125, PGT-126, PGT-127, PGT-128, PGT-130, PGT-131, PGT-135, PGT-136, PGT-137, PGT-141, PGT-142, PGT-143, PGT-144, PGT-145, and PG9, expressed as the half-maximal inhibitory concentration, or $IC_{50}$ (μg/ml). The bar for each antibody represents the median $IC_{50}$ value.

FIG. 33A-33D is a series of graphs depicting the newly identified PGT antibodies redefine broad and potent neutralisation of HIV. A, Key MAbs fully recapitulate serum neutralization by the corresponding donor serum. Serum breadth was correlated with the breadth of the broadest MAb for each donor (% viruses neutralized at $NT_{50}$>100 or $IC_{50}$<50 μg/ml, respectively). Of note, MAbs isolated from donor 39 could not completely recapitulate the serum neutralization breadth. B-D. Certain antibodies or antibody combinations are able to cover a broad range of HIV isolates at low, vaccine achievable, concentrations. B, Cumulative frequency distribution of $IC_{50}$ values of broadly neutralizing MAbs tested against a 162-virus panel. The y-axis shows the cumulative frequency of $IC_{50}$ values up to the concentration shown on the x-axis and can therefore also be interpreted as the breadth at a specific $IC_{50}$ cut-off. C-D, Percent viruses covered by single MAbs (solid lines) or by at least one of the MAbs in dual combinations (dashed black lines) dependent on individual concentrations. The grey area in both panels is the coverage of 26 MAbs tested on the 162-virus panel (PGT121-123, PGT125-128, PGT130-131, PGT135-137, PGT141-145, PG9, PG16, PGC14, VRC01, PGV04, b12, 2G12, 4E10, 2F5) and depicts the theoretical maximal achievable coverage known to date.

FIG. 34A is a table depicting the competition of PGT MAbs with sCD4 (soluble CD4), b12 (anti-CD4bs), 2G12 (anti-glycan), F425/b4e8 (anti-V3), X5 (CD4i), PG9 (anti-V1N2 and V3, quaternary) and each other. Competition assays were performed by ELISA using gp120$^{Bal}$ or gp120$_{JR-FL}$, except for the PG9 competition assay, which was performed on the surface of JR-FL$_{E168K}$ or JR-CSF transfected cells. Experiments were performed in duplicate, and data represent an average of at least two independent experiments.

FIG. 34B-34D is a series of graphs depicting the epitope mapping of PGT antibodies. b, Glycan microarray analysis (Consortium for Functional Glycomics, CFG, v 5.0) reveals that PGT MAbs 125, 126, 127, 128, and 130 contact $Man_8$ (313), $Man_8GlcNAc_2$ (193), $Man_9$ (314) and $Man_9GlcNAc_2$ (194) glycans directly. Only glycans structures with RFU (relative fluorescent units) >3000 are shown. PGT-131 showed no detectable binding to the CFG glycan array but bound to $Man_9$-oligodendrons[30] (data not shown). Error bars represent standard deviation. c, d, Binding of PGT MAbs 125, 126, 127, 128 and 130 to gp120 is competed by $Man_9$ oligodendrons but not $Man_4$ oligodendrons. Binding of 131 to immobilized gp120 was too low to measure any competition.

FIG. 35A-35D is a series of graphs depicting the lack of polyreactivity of PGT monoclonal antibodies (mAbs) in ELISA assay. PGT mAbs were tested for ELISA reactivity against a panel of antigens. The bNAbs b12 and 4E10 were also included for comparison. d.s, double-stranded; s.s, single-stranded.

FIG. 36A-36D is a series of graphs depicting the results of an analysis of neutralization activity by virus clades. Cumulative frequency distribution of IC50 values of broadly neutralizing Mabs tested against a 162 virus panel separated by clades A, B, C, D, F, G, AE and AG. VRC01 was tested on a different virus panel (n=190, ref 6).

FIG. 37A-37D is a series of graphs showing that MAb neutralization correlates strongly with serum neutralization. Correlation of $IC_{50}$s of the MAbs and serum $NT_{50}$s of the corresponding donors 17 (a), 36 (b), 39 (c) and 84 (d) is shown. Spearman correlation was used for statistical analyses. Only viruses neutralized by either the MAb ($IC_{50}$<50 μg/ml) or the serum ($NT_{50}$>100) were included.

Figure 38A:
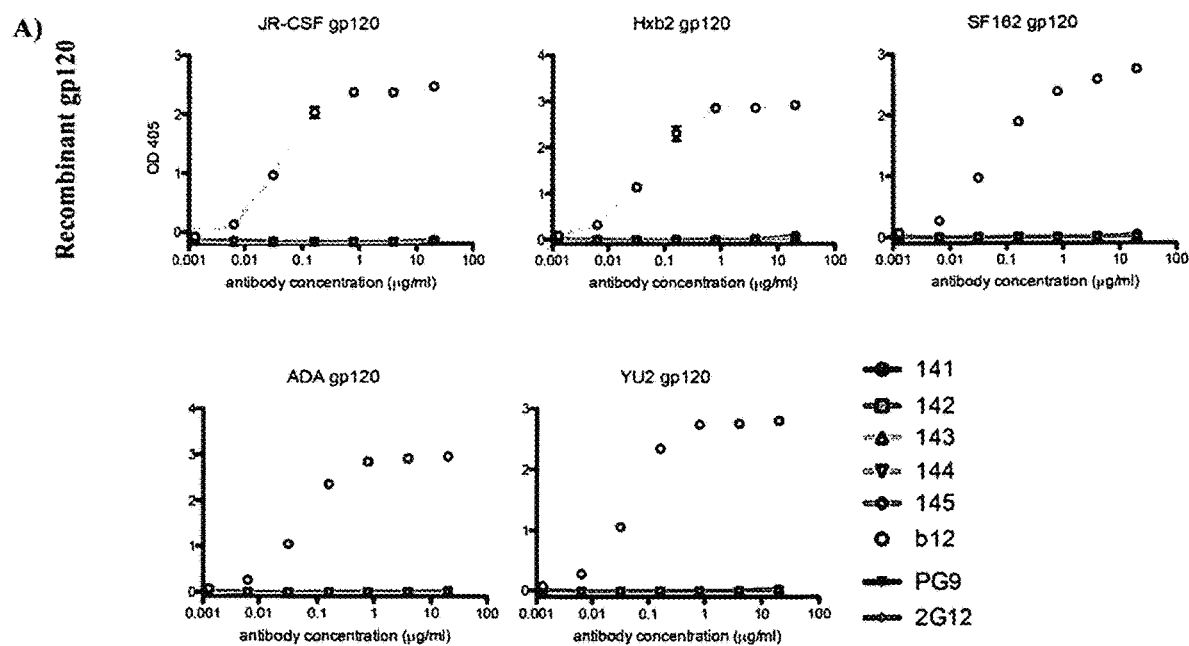
Figure 38B:
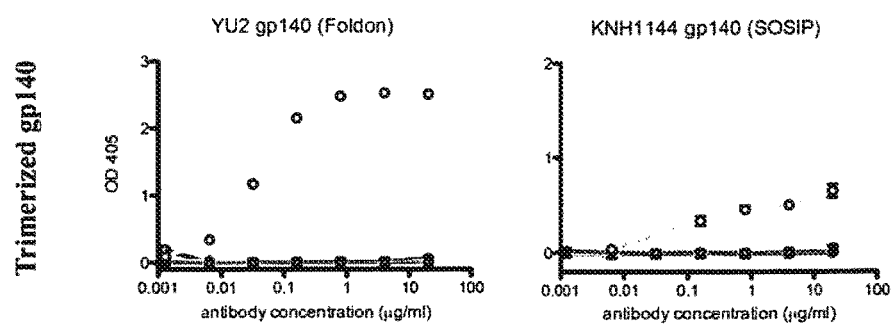
Figure 38C:
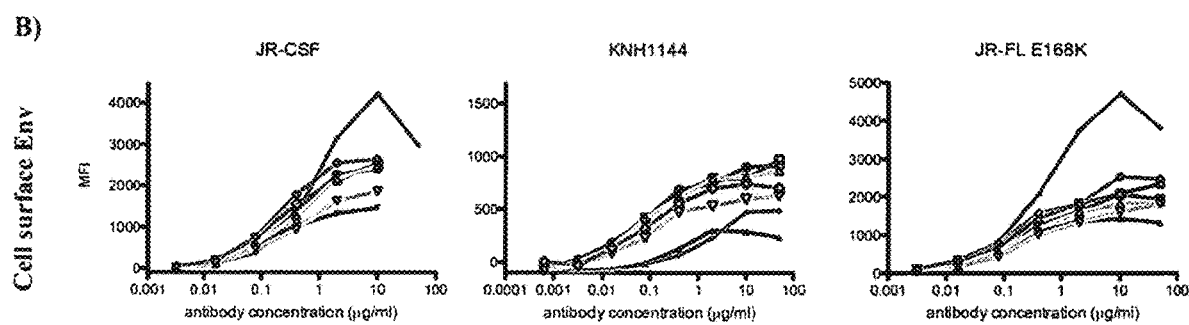

FIG. 38A-38C is a series of graphs showing that PGT 141-145 bind preferentially to cell-surface expressed trimers. A) Binding of PGTs 141-145 to monomeric gp120 and artificially trimerized gp140 constructs as determined by ELISA. The bNAbs b12 and PG9 are included for comparison. OD, optical density (absorbance at 450 nm). B) Binding of PGTs 141-145 to Env expressed on the surface of 293T cells as determined by flow cytometry. The bNAbs 2G12 and PG9 are included for comparison.

Figure 39A:
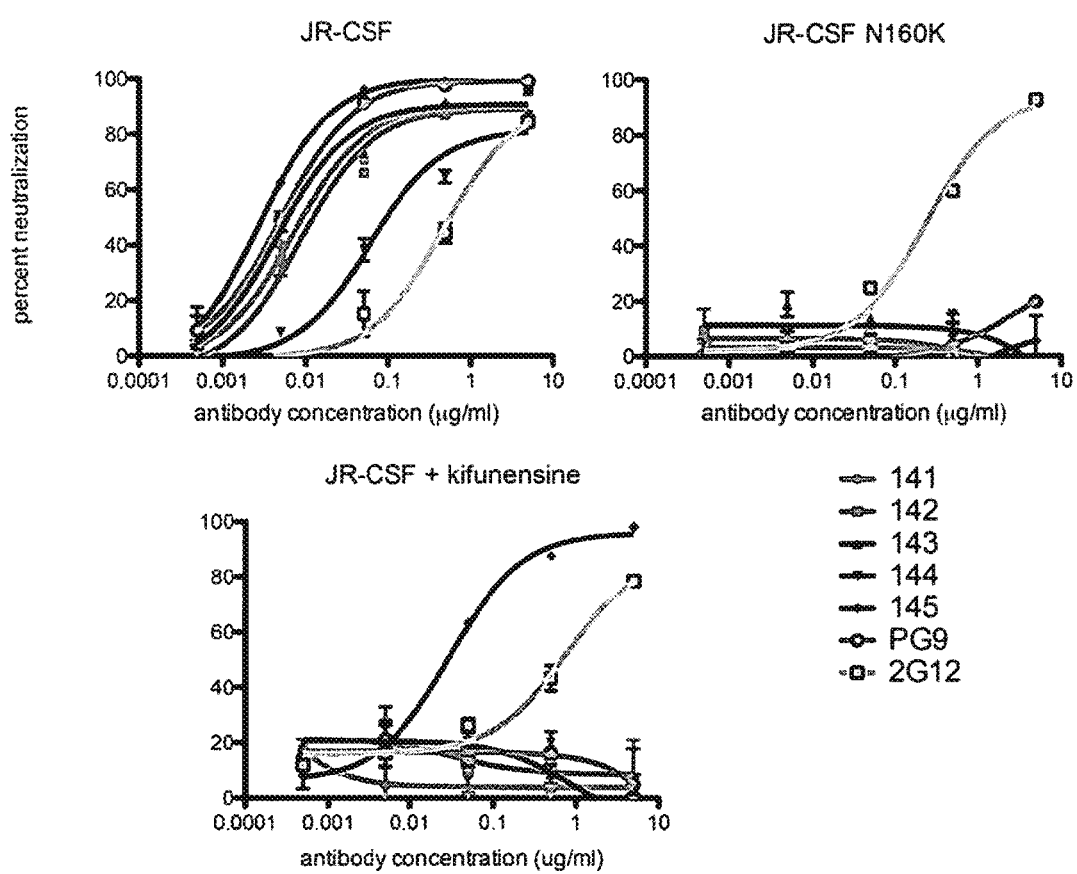
Figure 39B:
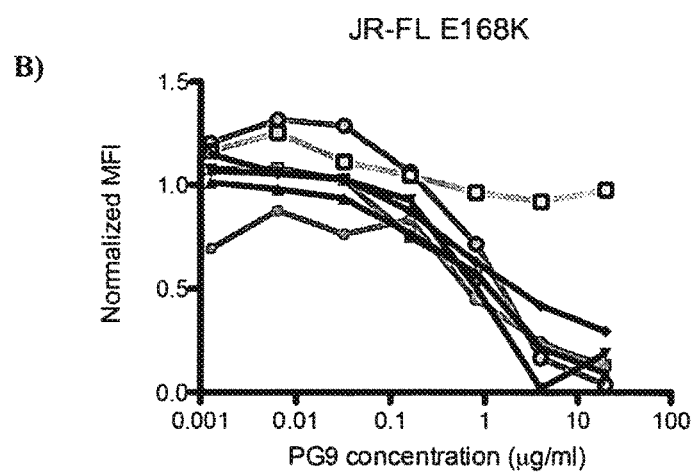

FIG. 39A-39B is a series of graphs showing that PGT mAbs 141-145 bind to epitopes overlapping those of PG9 and PG16. A) PGTs 141-145 are sensitive to the N160K mutation and PGTs 141-144 fail to neutralize pseudoviruses produced in the presence of kifunensine. The bNAb 2G12 was also included for comparison. B) PG9 competes with PGTs 141-145 for binding to cell-surface trimers. The bNAb 2G12 was included as a negative control.

Figure 40A:
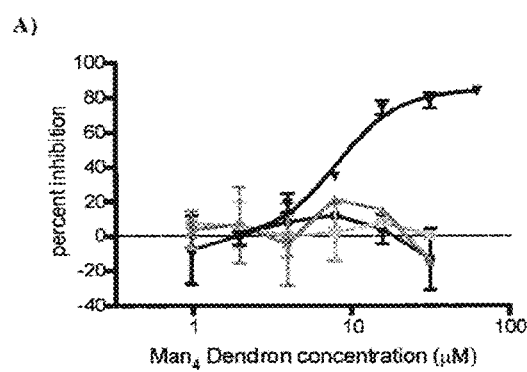
Figure 40B:
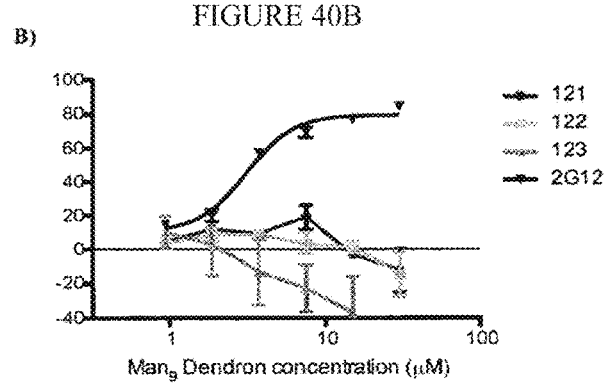

FIG. 40A-40B is a series of graphs showing PGTs 121, 122 and 123 in competition with oligodendrons. Unlike PGTs 125, 126, 127, 128 and 130, the binding of PGTs 121, 122 and 123 to gp120 could not be competed by A) $Man_4$ or B) $Man_9$ dendrons.

Figure 41:
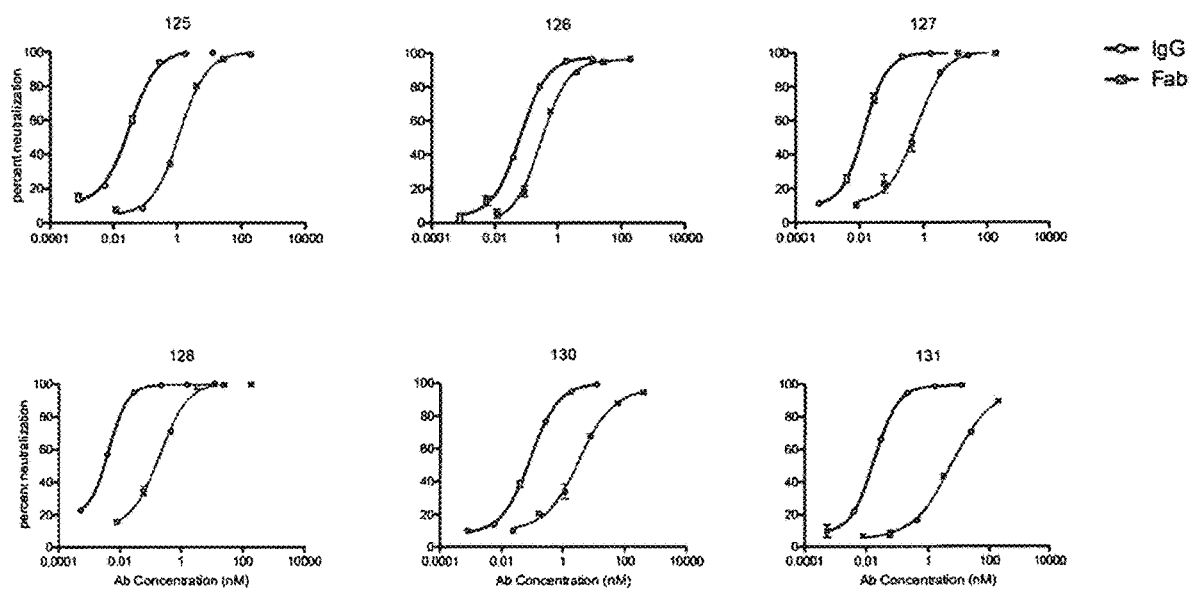

FIG. 41 is a series of graphs showing the neutralization activity of Fab fragments. Fab fragments of PGTs-125, 126, 127, 128, 130 and 131 were generated by Lys-C digestion and the neutralizing activity tested against HIV-1$_{JR-CSF}$ using a single round of replication pseudovirus assay.

Figure 42A:
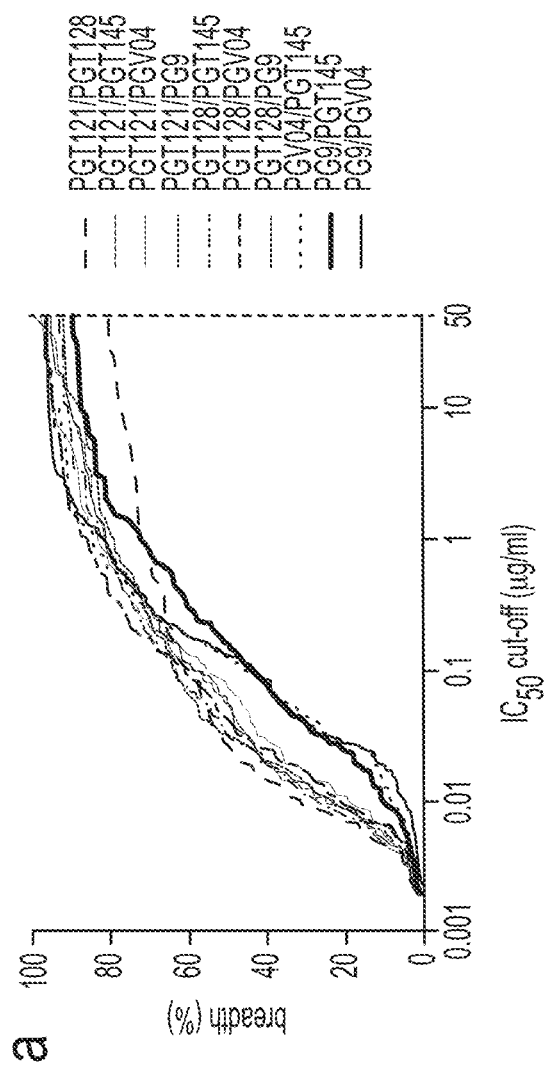
Figure 42B:
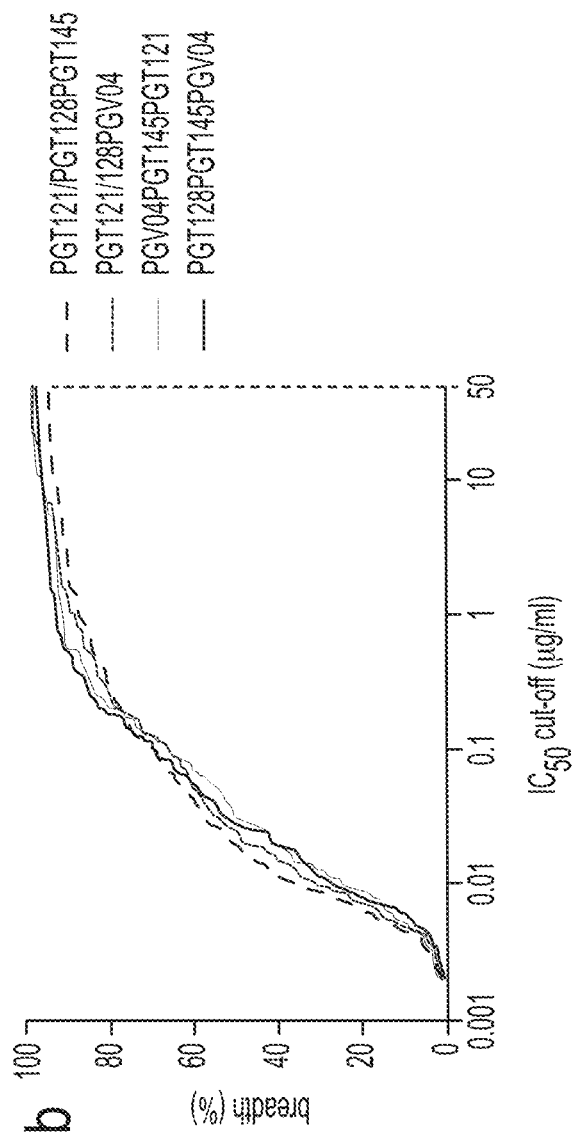

FIG. 42A-42B is a series of graphs showing that the combination of two or three antibody specificities is sufficient to cover a broad range of HIV isolates at vaccine achievable concentration. Cumulative frequency distribution of IC50 values of double (a) and triple (b) combinations of neutralization activities (overall lowest IC50 against each isolate). The grey area depicts the theoretical maximal achievable neutralization activity known to date.

Figure 43A:
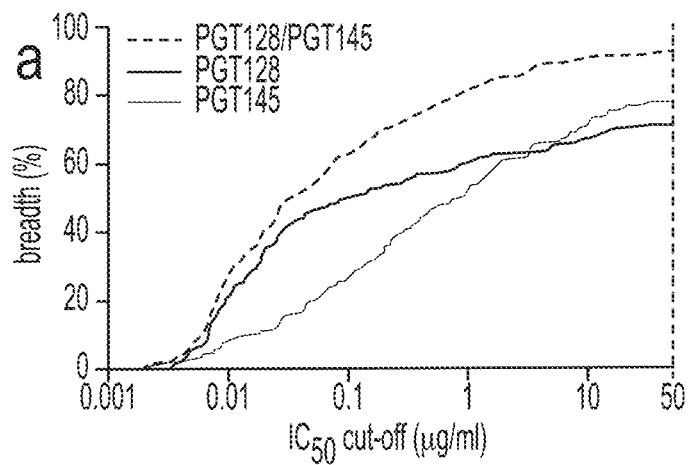
Figure 43B:
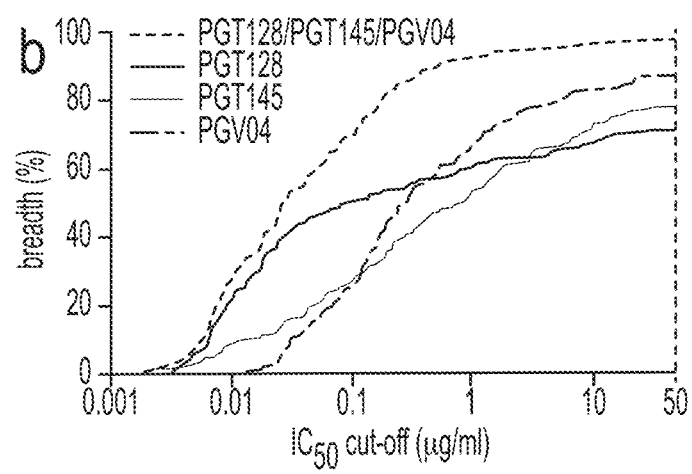
Figure 43C:
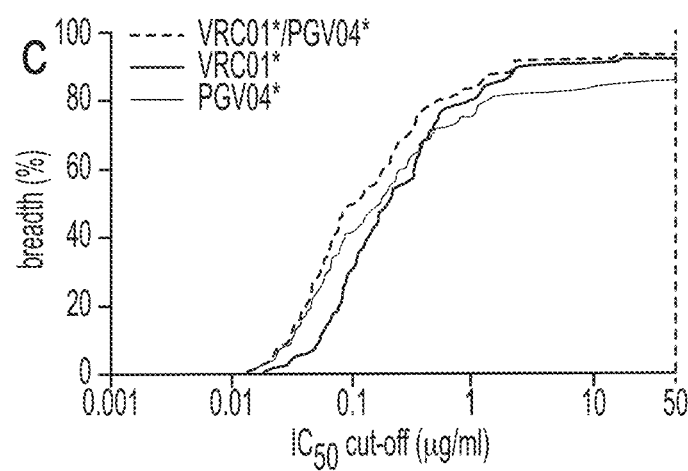
Figure 44M:
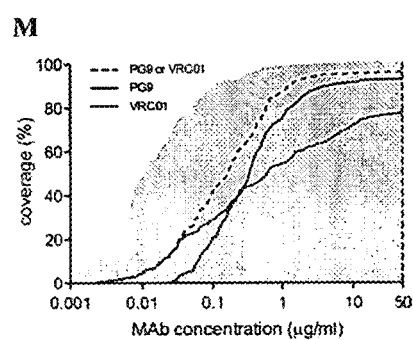

FIG. 43A-43C is a series of graphs showing that combinations of two or three antibody specificities are sufficient to cover a broad range of HIV isolates at vaccine achievable concentrations. A-C Cumulative frequency distribution of IC50 values of single MAbs (solid lines) and combined neutralisation activity (overall lowest $IC_{50}$ against each isolate) of two or three MAbs (dashed lines). The grey area is the combined neutralisation activity of 25 MAbs tested on the 162-virus panel (b12, 2G12, 4E10, 2F5, PG9, PG16, PGC14, PGV04, PGTs 121-123, PGTs 125-128, PGTs 130-131, PGTs 135-137, PGTs 141-145) and depicts the theoretical maximal achievable neutralisation activity known to date. VRC01 and PGV04 in panel c are measured on a different virus panel (n=97).

FIG. 44A-44M is a series of graphs depicting the percent of viruses covered by single MAbs (solid lines) or by at least one of the MAbs in dual combinations (dashed black lines) dependent on individual concentrations. The grey area in all panels is the coverage of 26 MAbs tested on the 162-virus panel (PGT121-123, PGT125-128, PGT130-131, PGT135-137, PGT141-145, PG9, PG16, PGC14, VRC01, PGV04, b12, 2G12, 4E10, 2F5) and depicts the theoretical maximal achievable coverage known to date.

Figure 45:
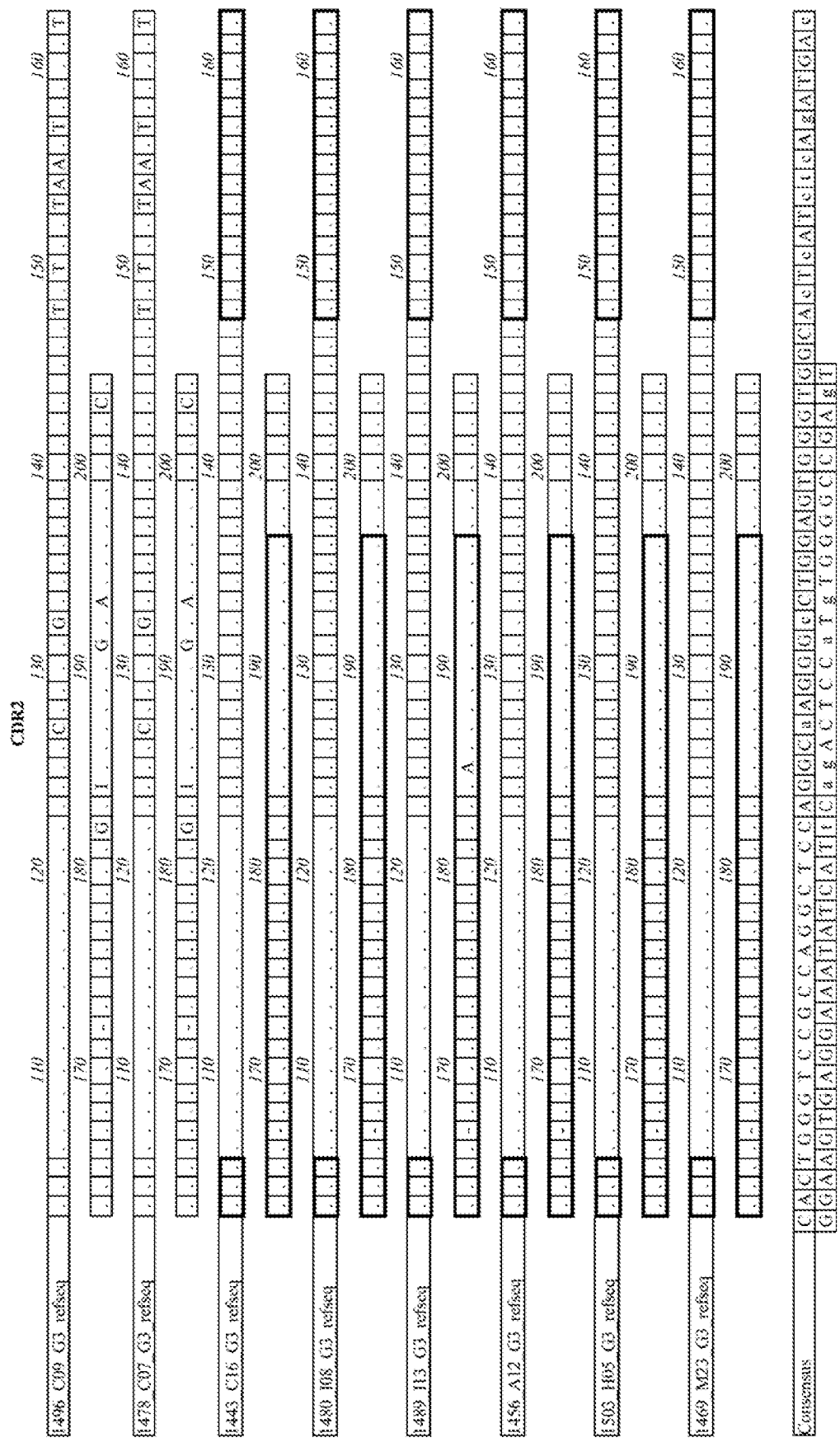
Figure 45:
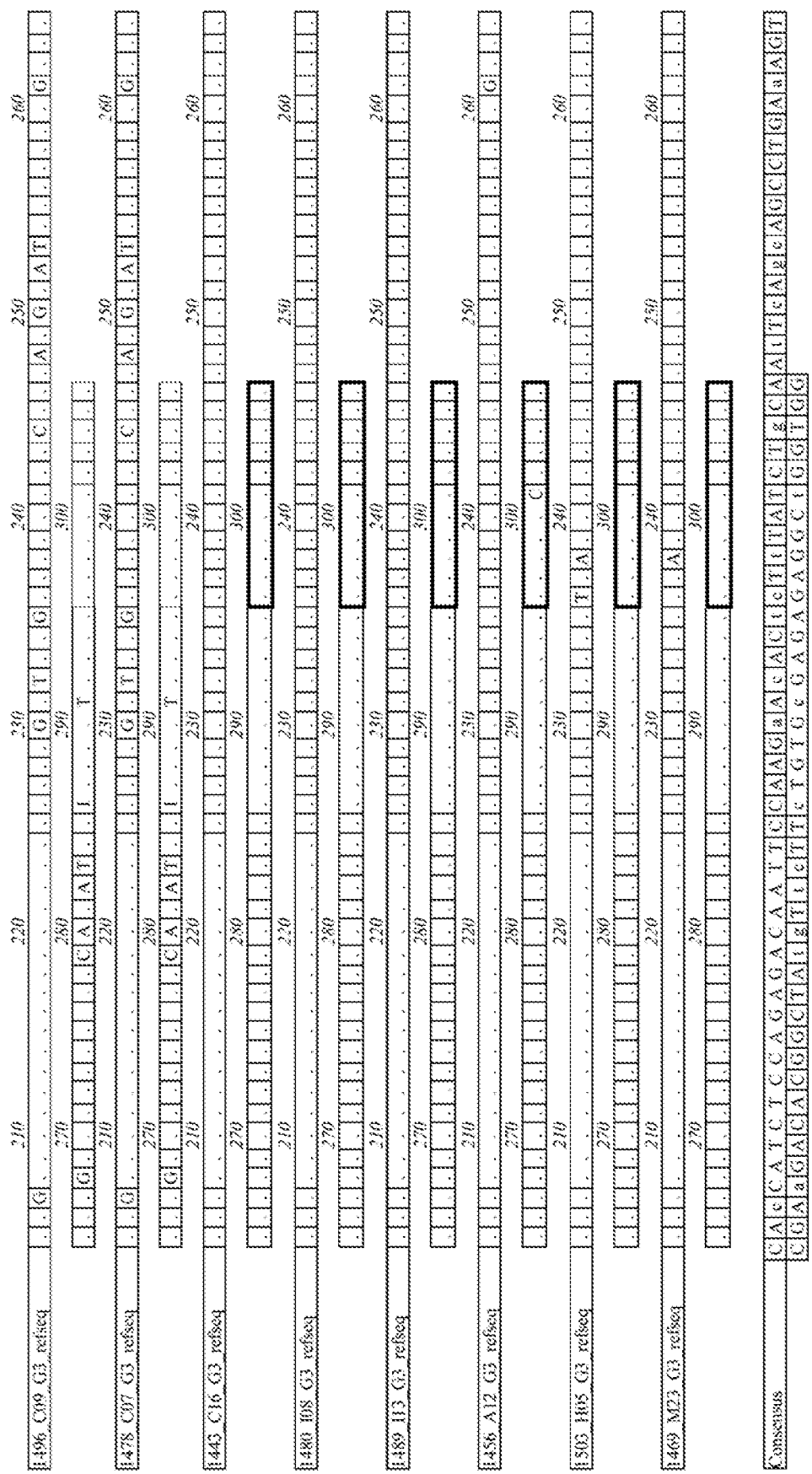
Figure 45:
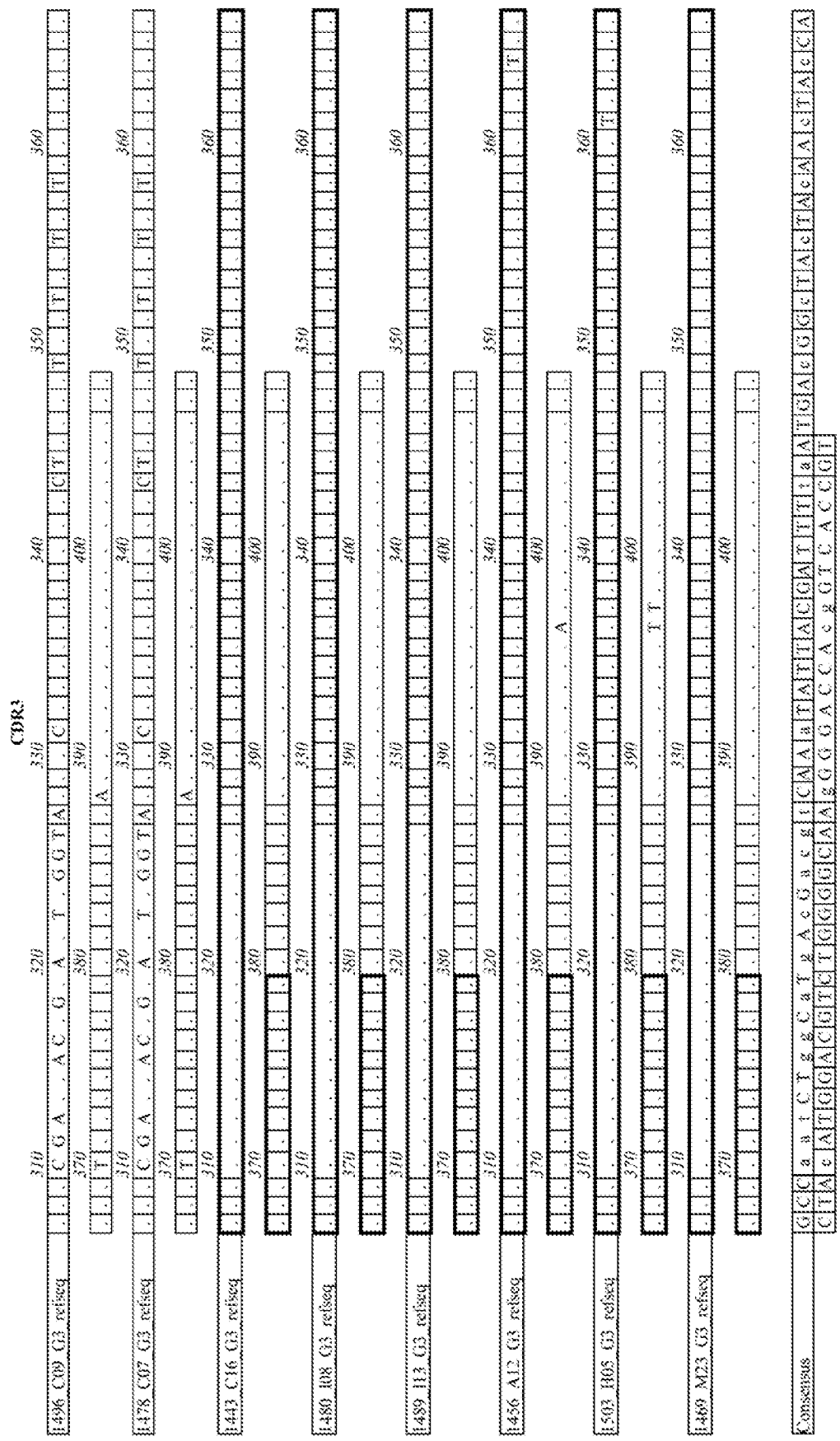

FIG. 45 is an alignment of heavy chain coding sequences of the variable domain of 1443 C16 sister clones to 1443 C16 and 1496 C09. The heavy chain coding sequences are set forth in the Sequence Listing as follows: 1496_C09_G3 refseq: SEQ ID NO:605, 1478_C07_G3 refseq: SEQ ID NO:605, 1443_C16_G3_refseq: SEQ ID NO:606, 1480_I08_G3 refseq: SEQ ID NO:607, 1489_I13_G3_refseq: SEQ ID NO:608, 1456_A12_G3_refseq: SEQ ID NO:609, 1503_H05_G3__refseq: SEQ ID NO:10, 1469_M23_G3__refseq: SEQ ID NO:611; and consensus: SEQ ID NO:640.

Figure 46:
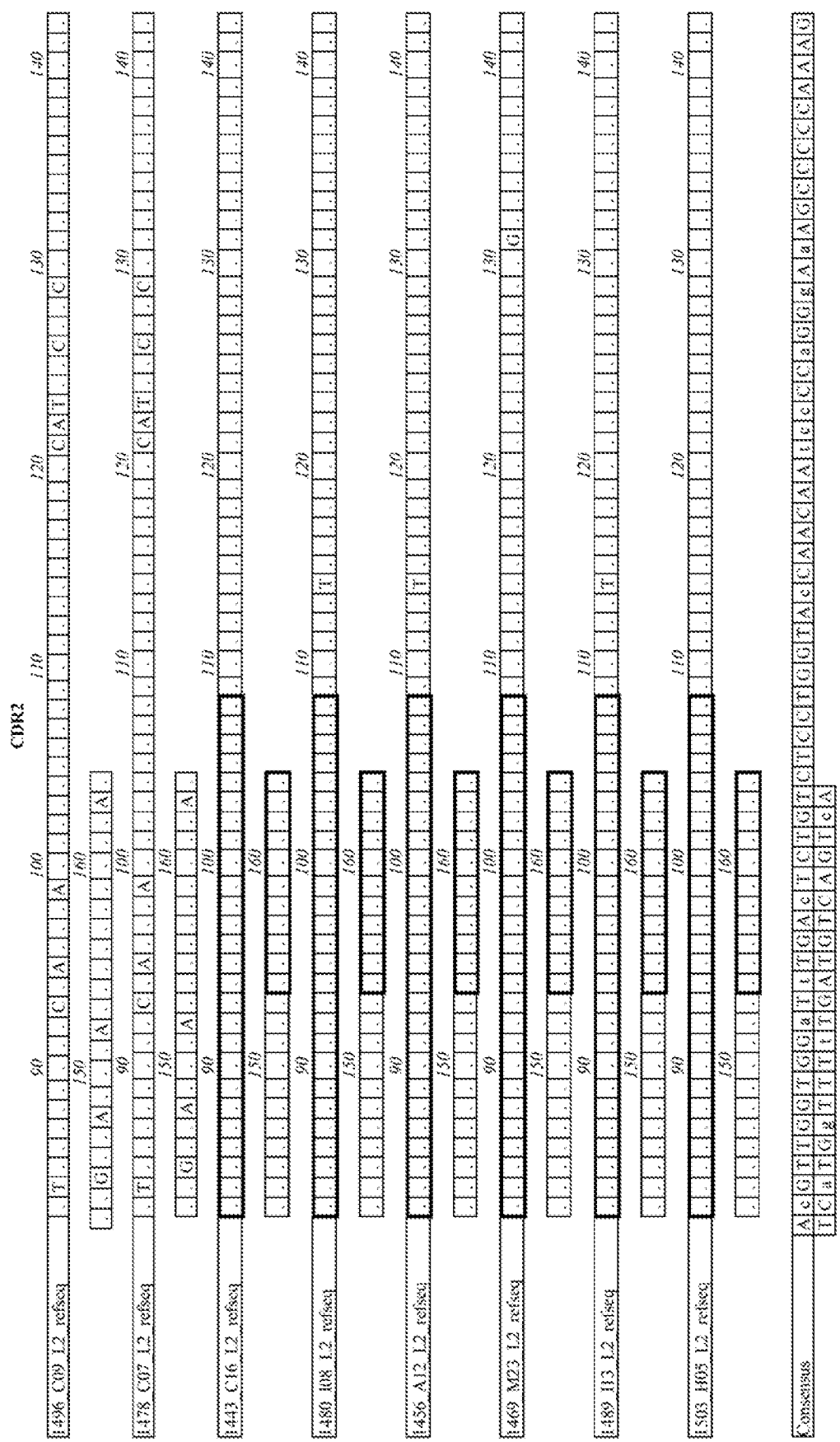
Figure 46:
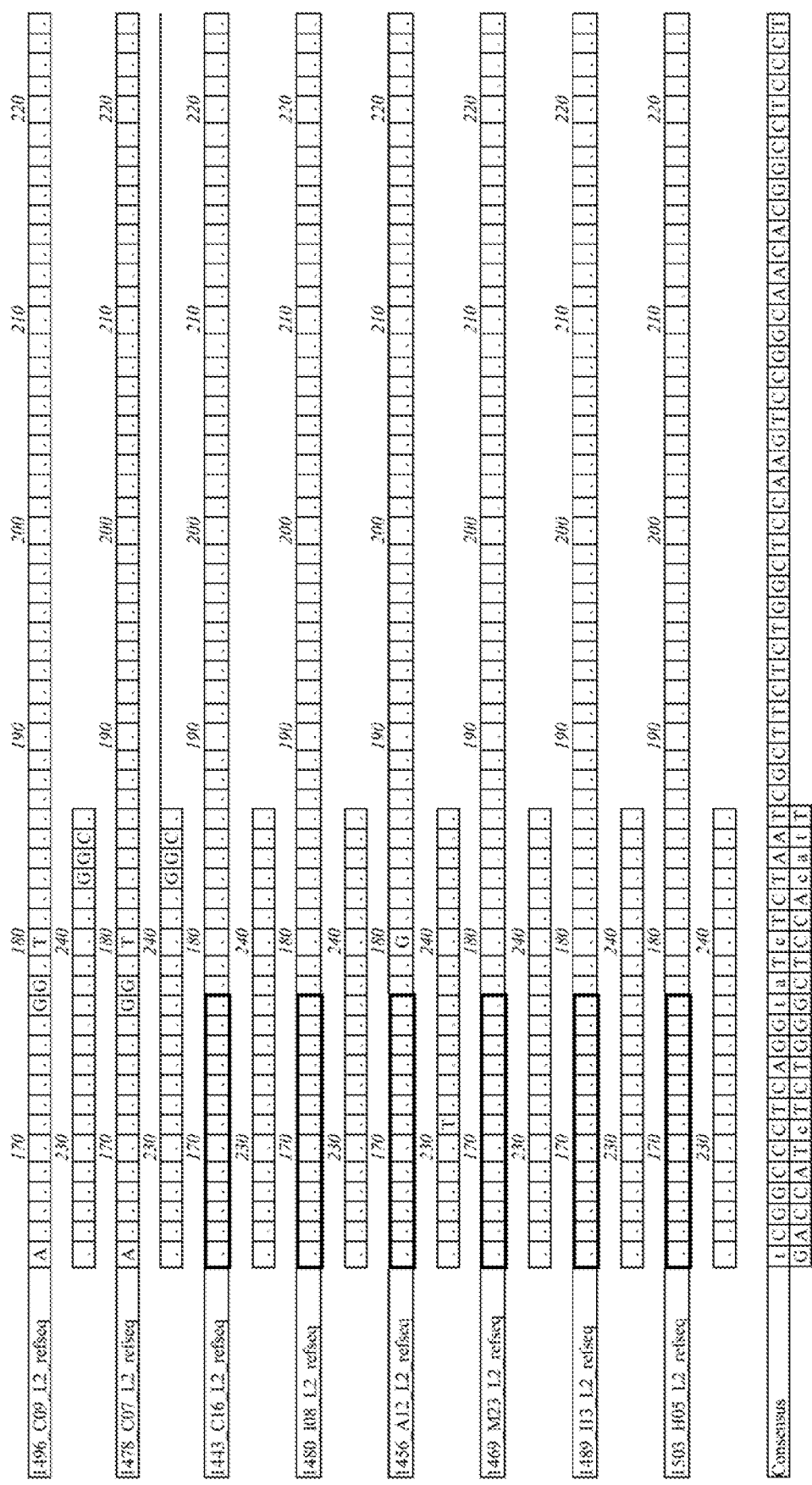

FIG. 46 is an alignment of light chain coding sequences of the variable domain of 1443 C16 sister clones to 1443 C16 and 1496 C09. The light chain coding sequences are set forth in the Sequence Listing as follows: 1496_C09_L2 refseq: SEQ ID NO:612, 1478_C07_L2_refseq: SEQ ID NO:652, 1443_C16_L2 refseq: SEQ ID NO:613; 1480_I08_L2__refseq: SEQ ID NO:614; 1456_A12_L2_refseq: SEQ ID NO:615; 1469_M23__L2_refseq: SEQ ID NO:616; 1489_I13_L2_refseq: SEQ ID NO:617; 1503_H05__L2__refseq: SEQ ID NO:618, and consensus: SEQ ID NO:641.

Figure 47:
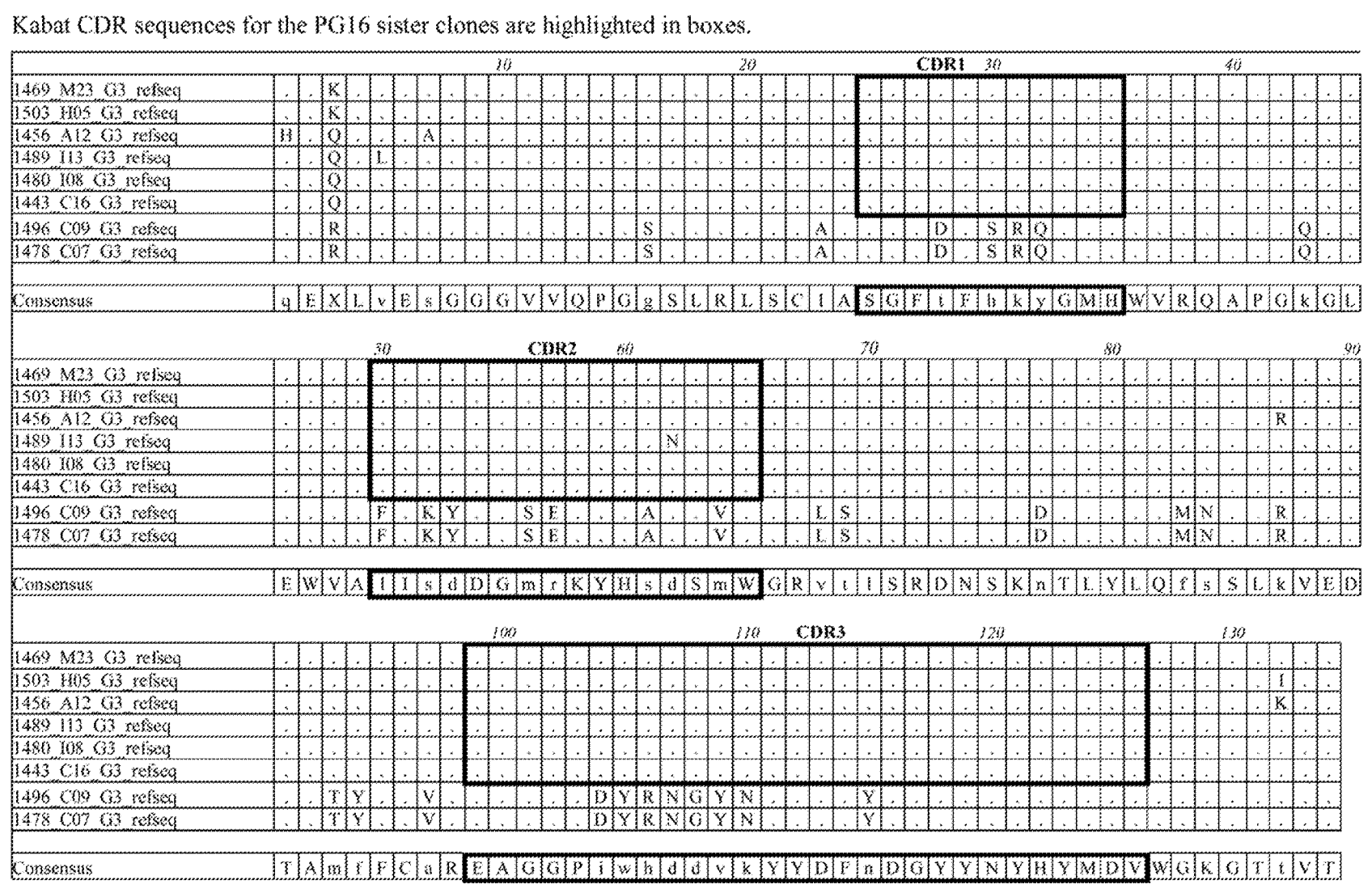

FIG. 47 is an alignment of heavy chain protein sequences of the variable domain of 1443 C16 sister clones to 1443 C16 and 1496 C09. The heavy chain protein sequences are set forth in the Sequence Listing as follows: 1469_M23_G3__refseq: SEQ ID NO:619; 1503_H05_G3__refseq: SEQ ID NO:620; 1456_A12_G3_refseq: SEQ ID NO:621; 1489_I13_G3_refseq: SEQ ID NO:622; 1480_I08_G3_refseq: SEQ ID NO:623; 1443_C16_G3__refseq: SEQ ID NO:623; 1496_C09_G3 refseq: SEQ ID NO:624; 1478_C07_G3_refseq: SEQ ID NO:624; and consensus: SEQ ID NO:640.

Figure 48:
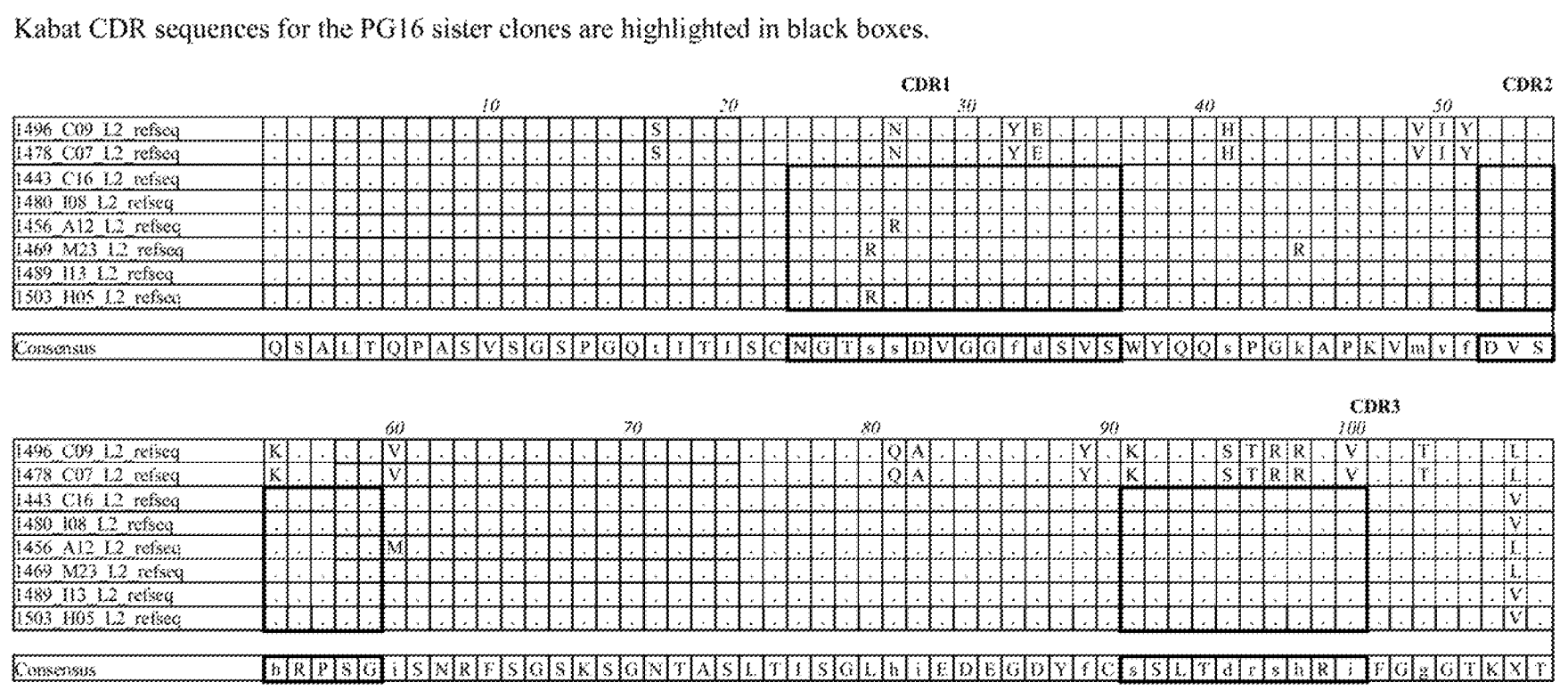

FIG. 48 is an alignment of light chain protein sequences of the variable domain of 1443 C16 sister clones to 1443 C16 and 1496 C09. The light chain protein sequences are set forth in the Sequence Listing as follows: 1496_C09_L2 refseq: SEQ ID NO:625; 1478_C07_L2_refseq: SEQ ID NO:625; 1443_C16_L2_refseq: SEQ ID NO:626; 1480_I08_L2__refseq: SEQ ID NO:626; 1456_A12_L2__refseq: SEQ ID NO:627; 1469__M23_L2_refseq: SEQ ID NO:628; 1489_I13_L2_refseq: SEQ ID NO:626; 1503_H05__L2_refseq: SEQ ID NO:629; and consensus: SEQ ID NO:641.

Figure 49:
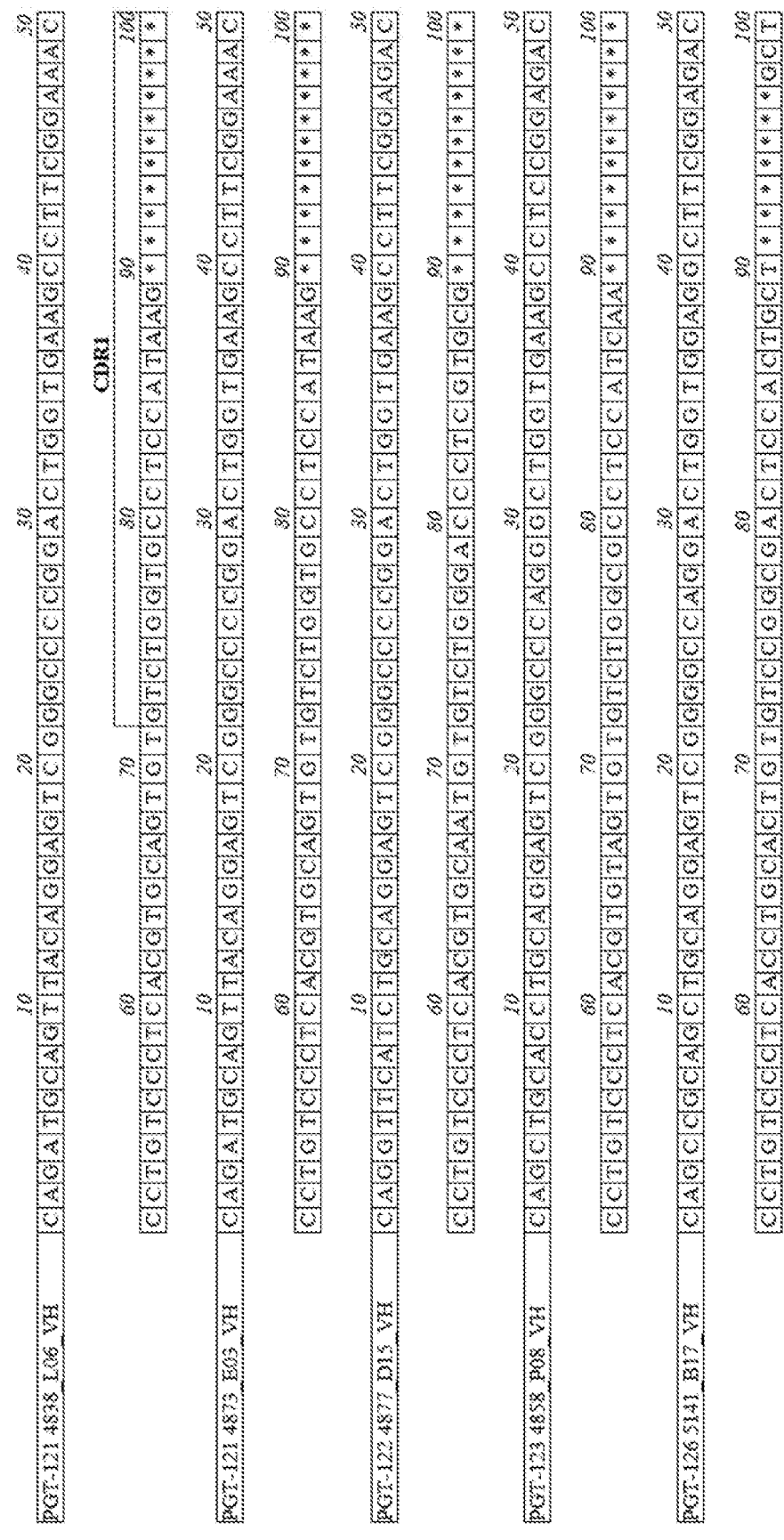
Figure 49:
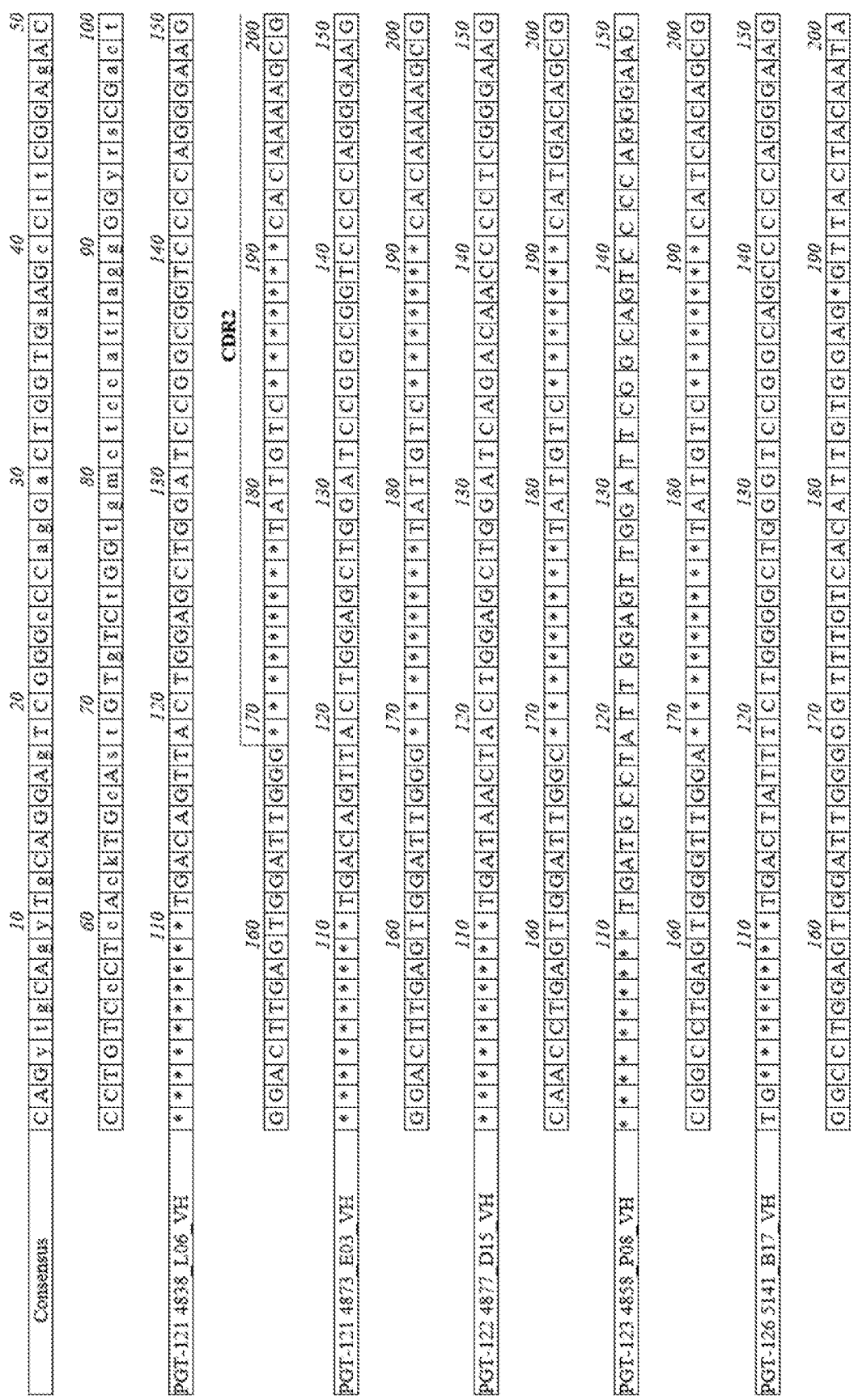
Figure 49:
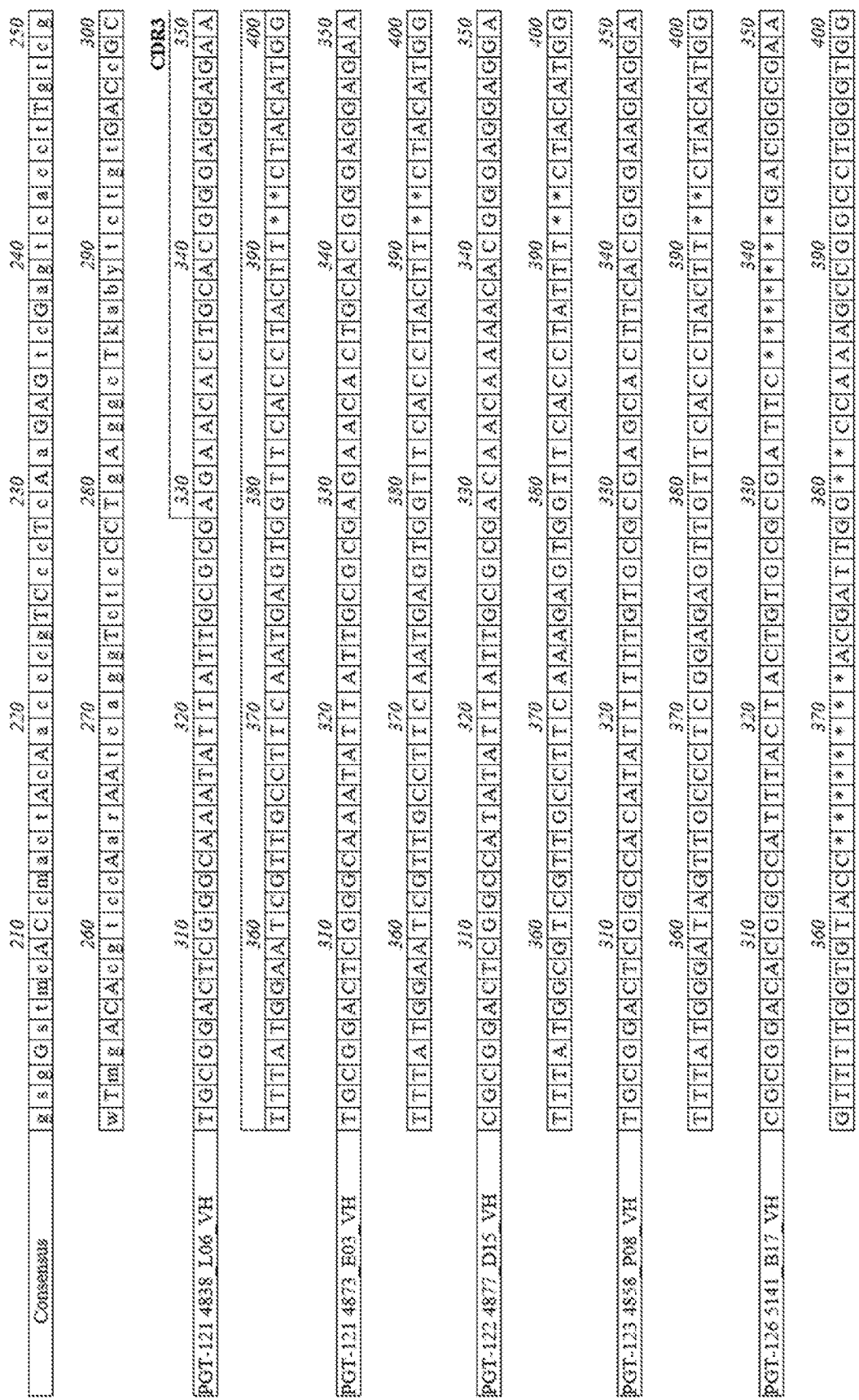
Figure 49:
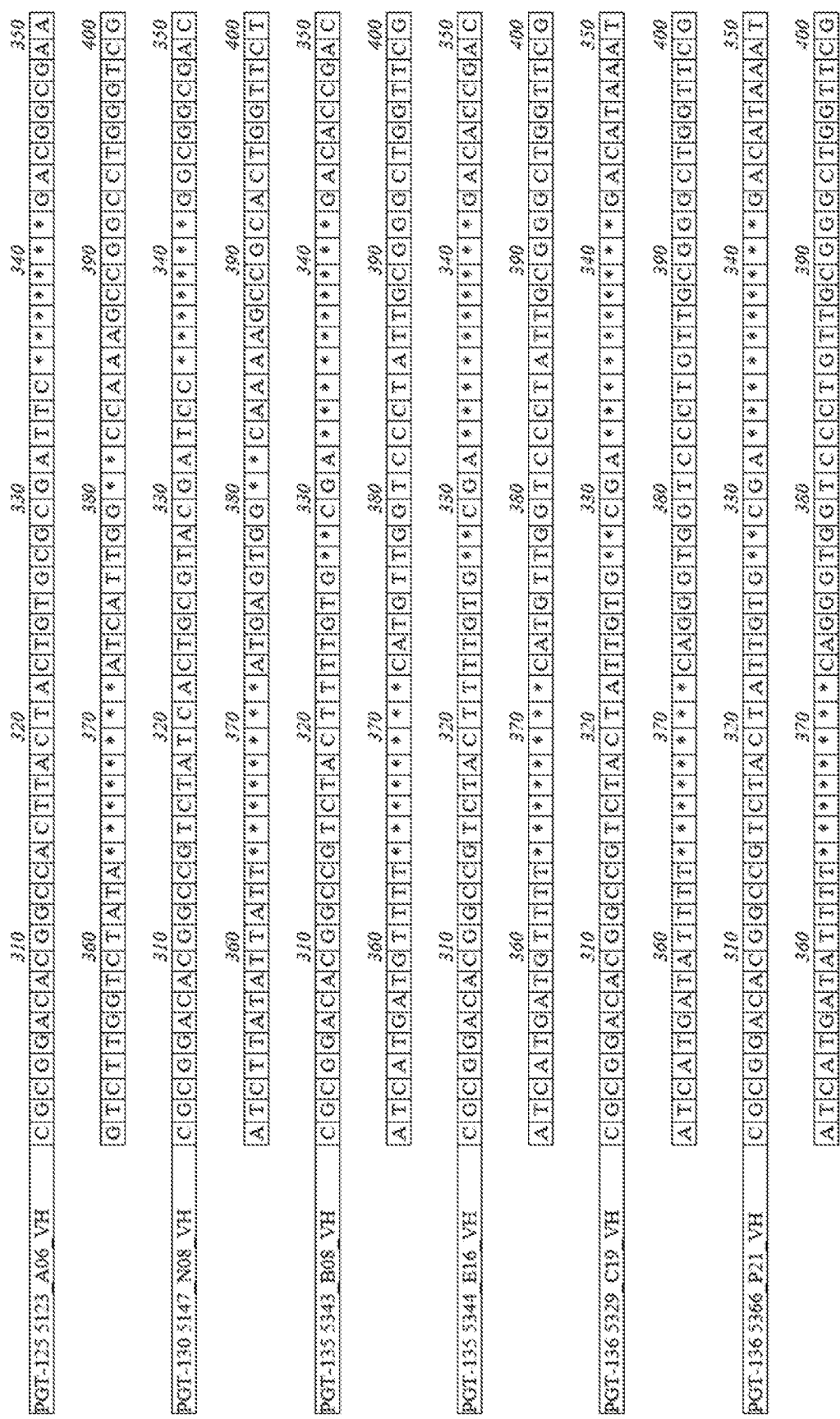
Figure 49:
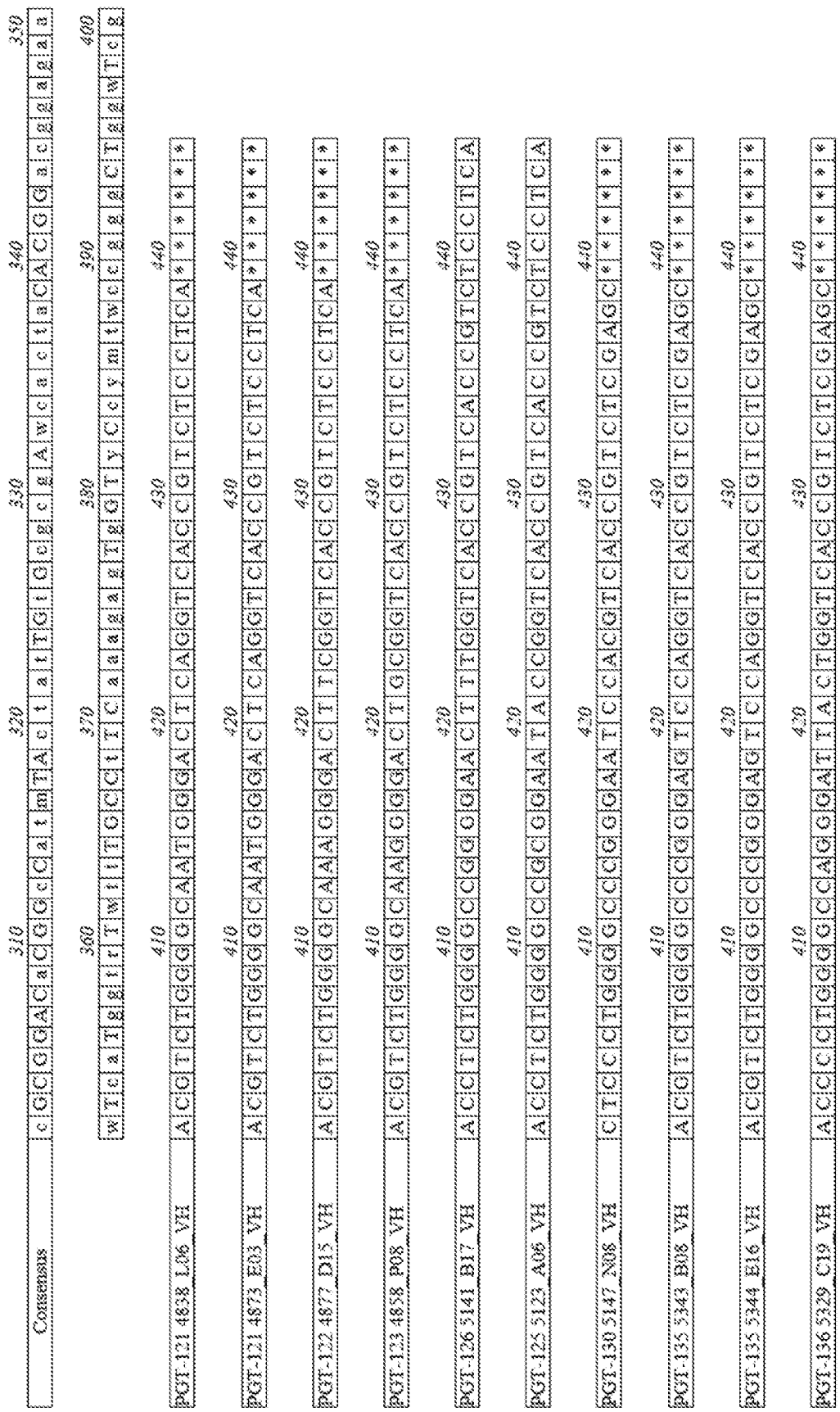

FIG. 49 is an alignment of heavy chain variable gene alignment for PGT-121, PGT-122, PGT-123, PGT-125, PGT-126, PGT-130, PGT 135, and PGT-136.

Figure 50:
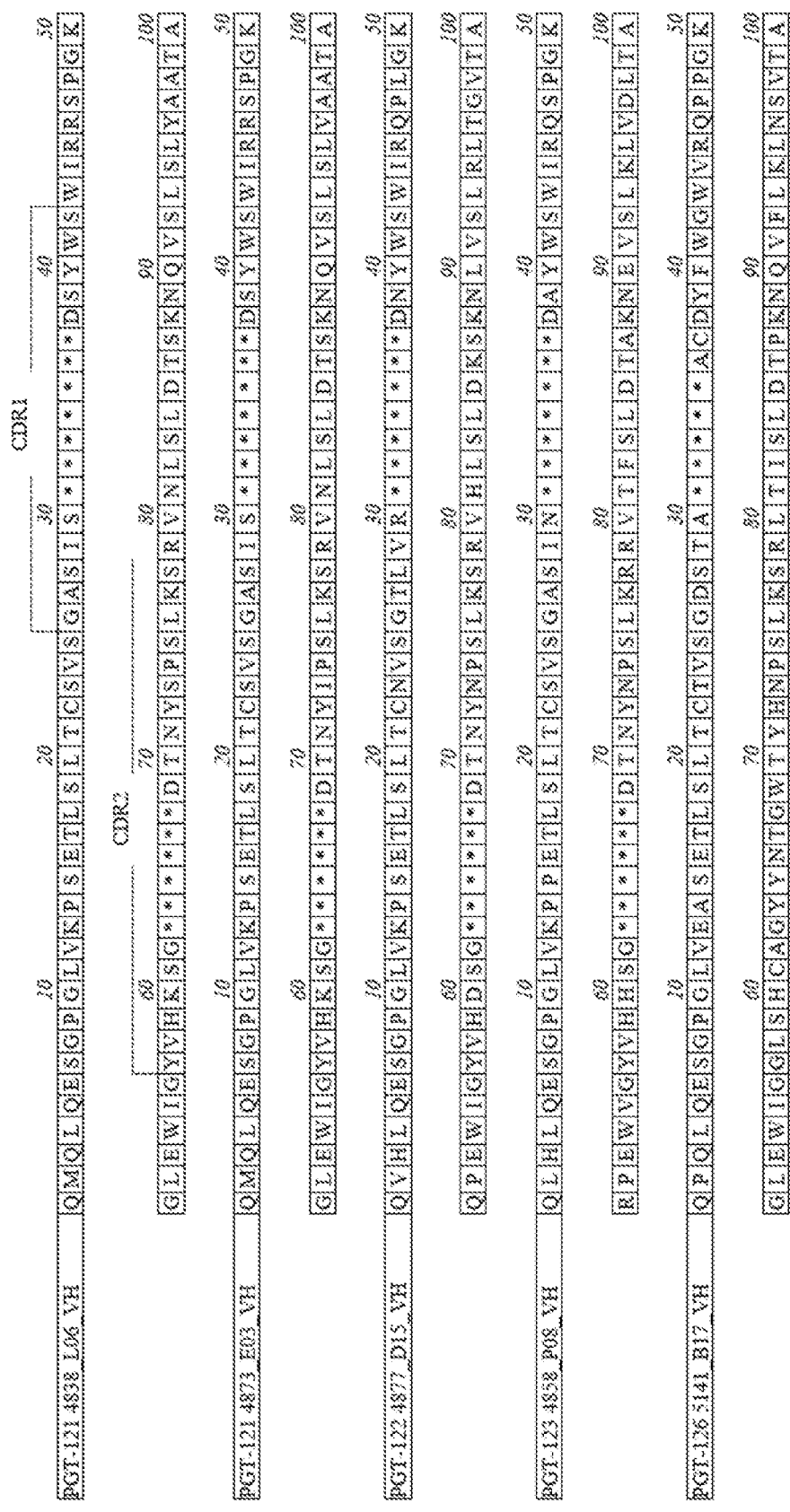
Figure 50:
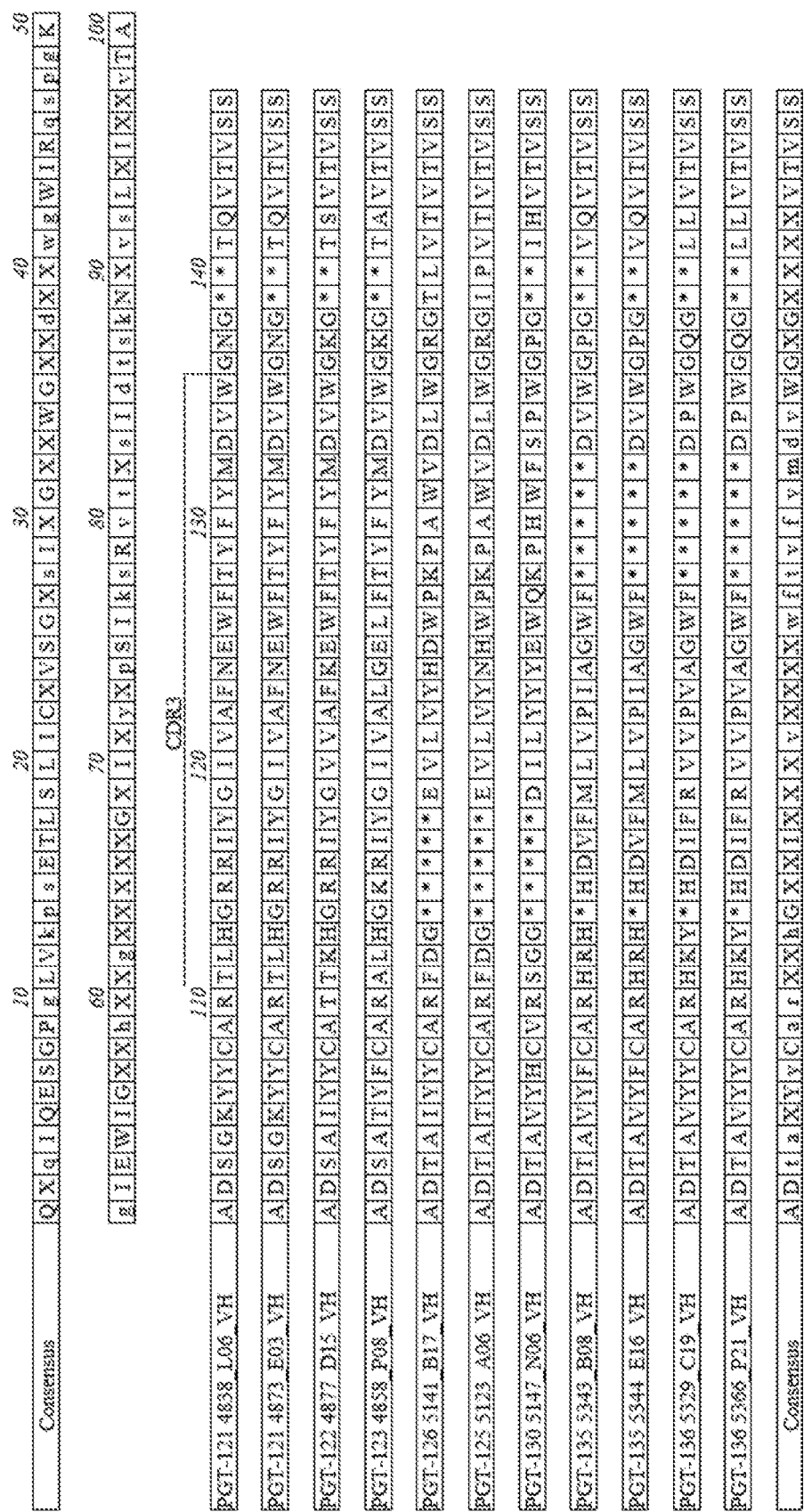

FIG. 50 is an alignment of heavy chain variable Protein alignment for PGT-121, PGT-122, PGT-123, PGT-125, PGT-126, PGT-130, PGT 135, and PGT-136.

Figure 51:
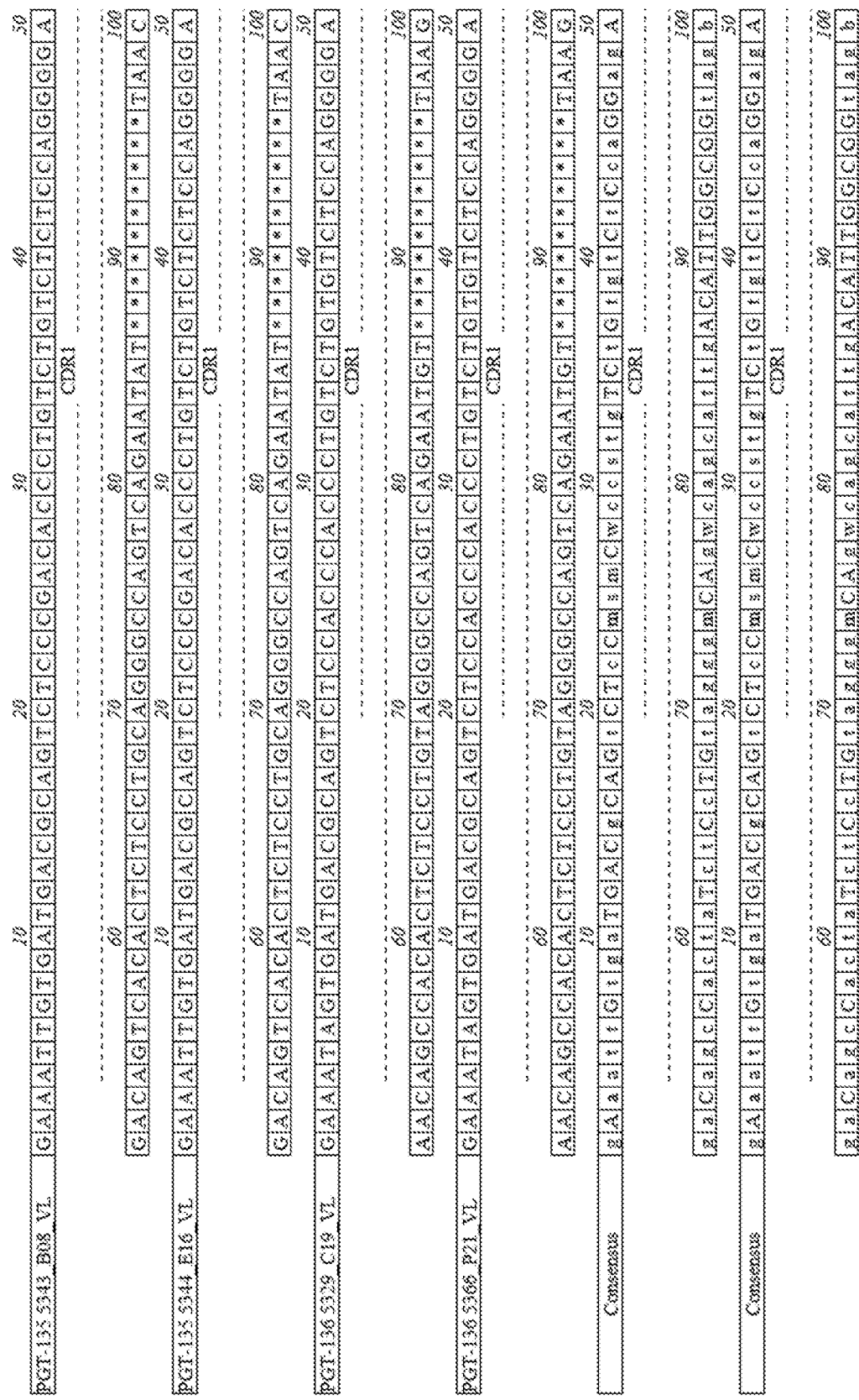
Figure 51:
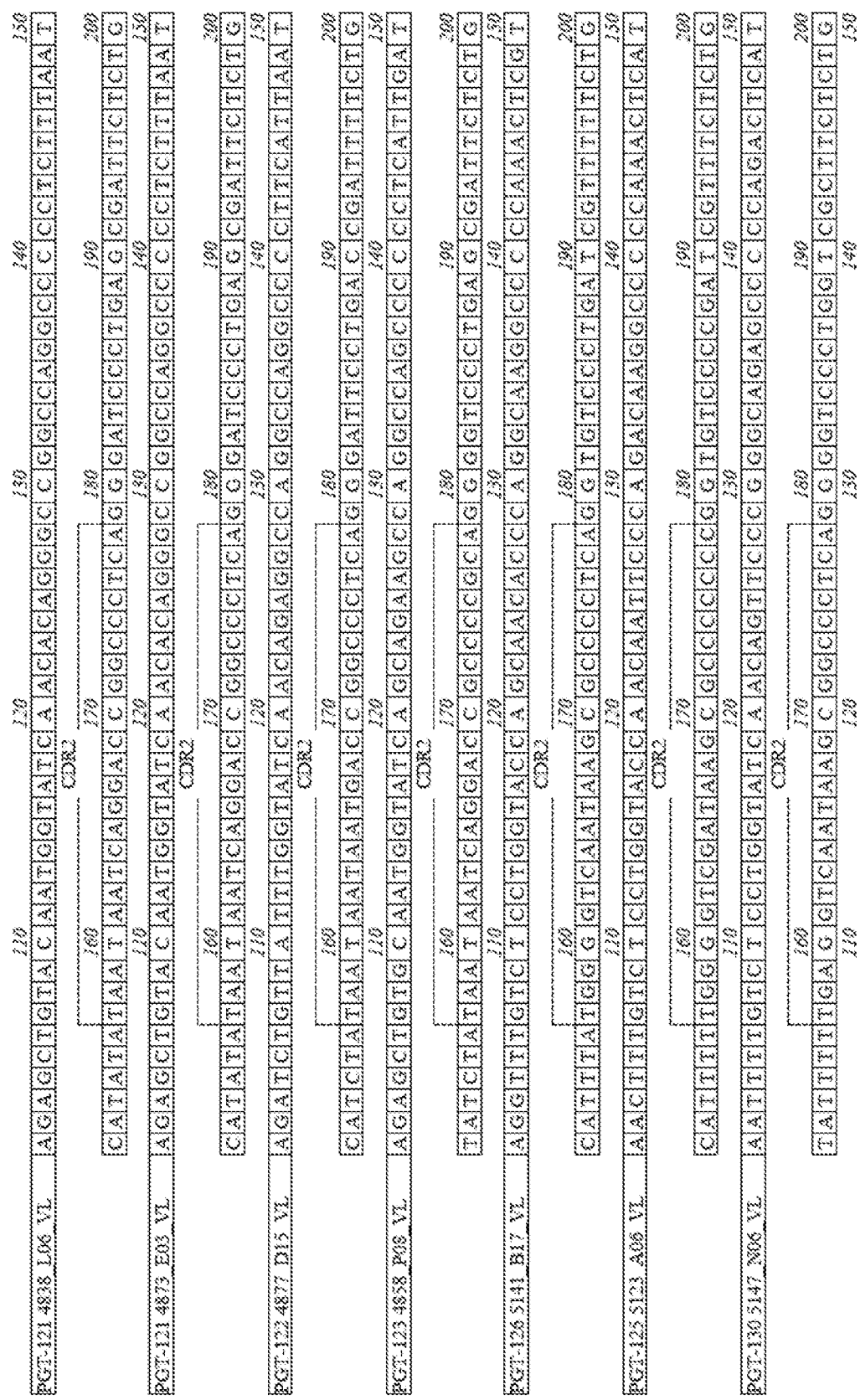
Figure 51:
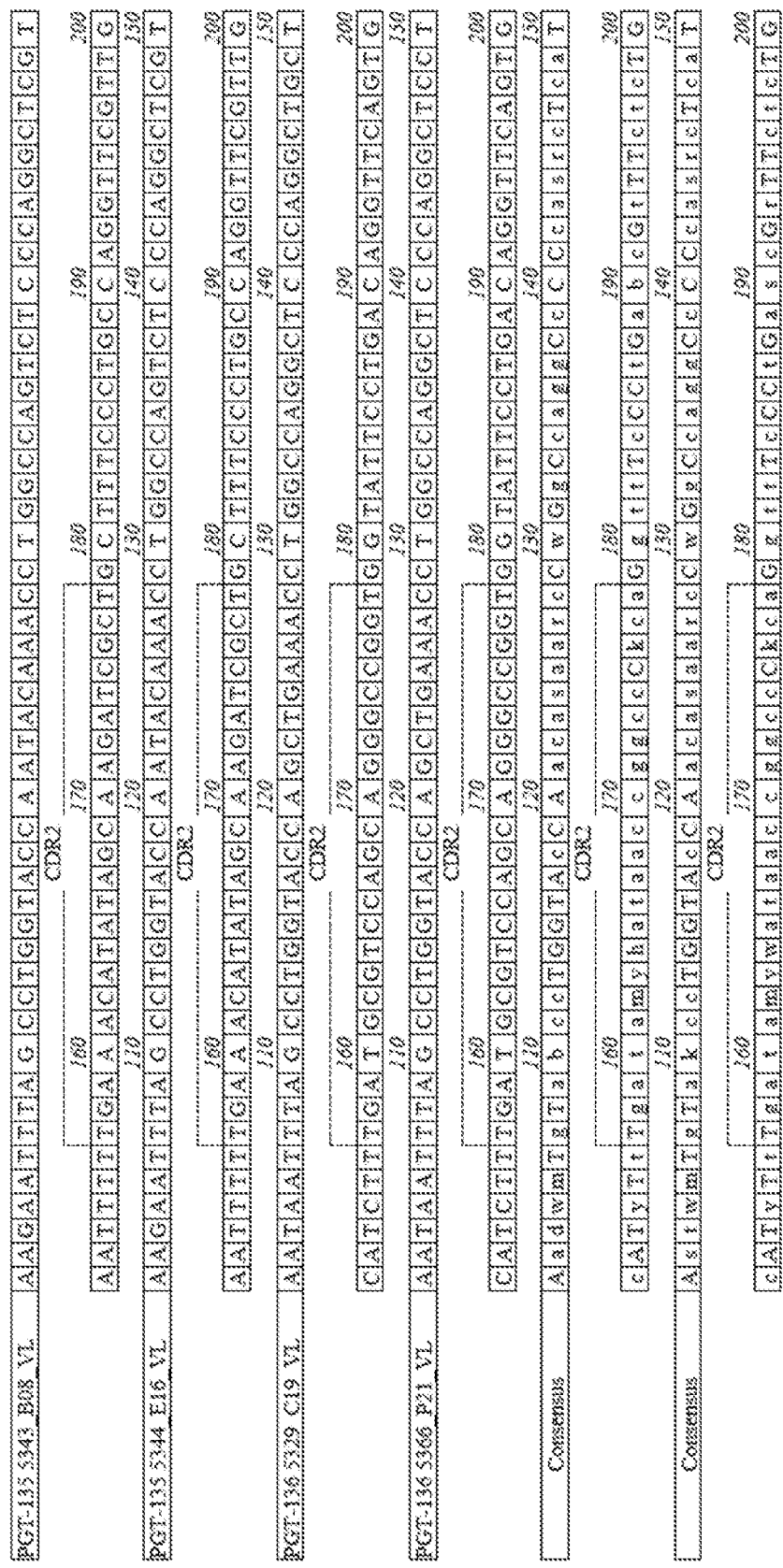
Figure 51:
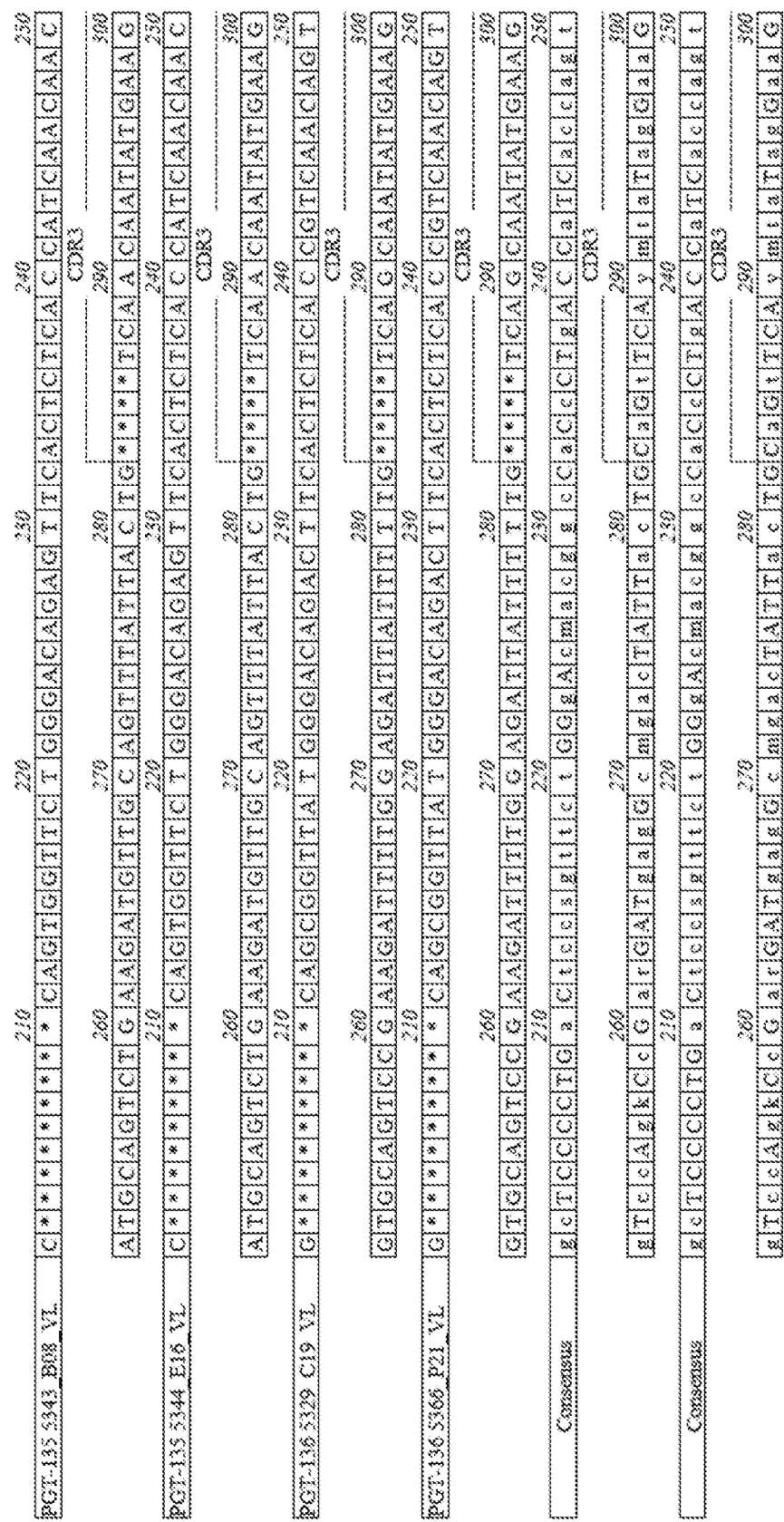
Figure 51:
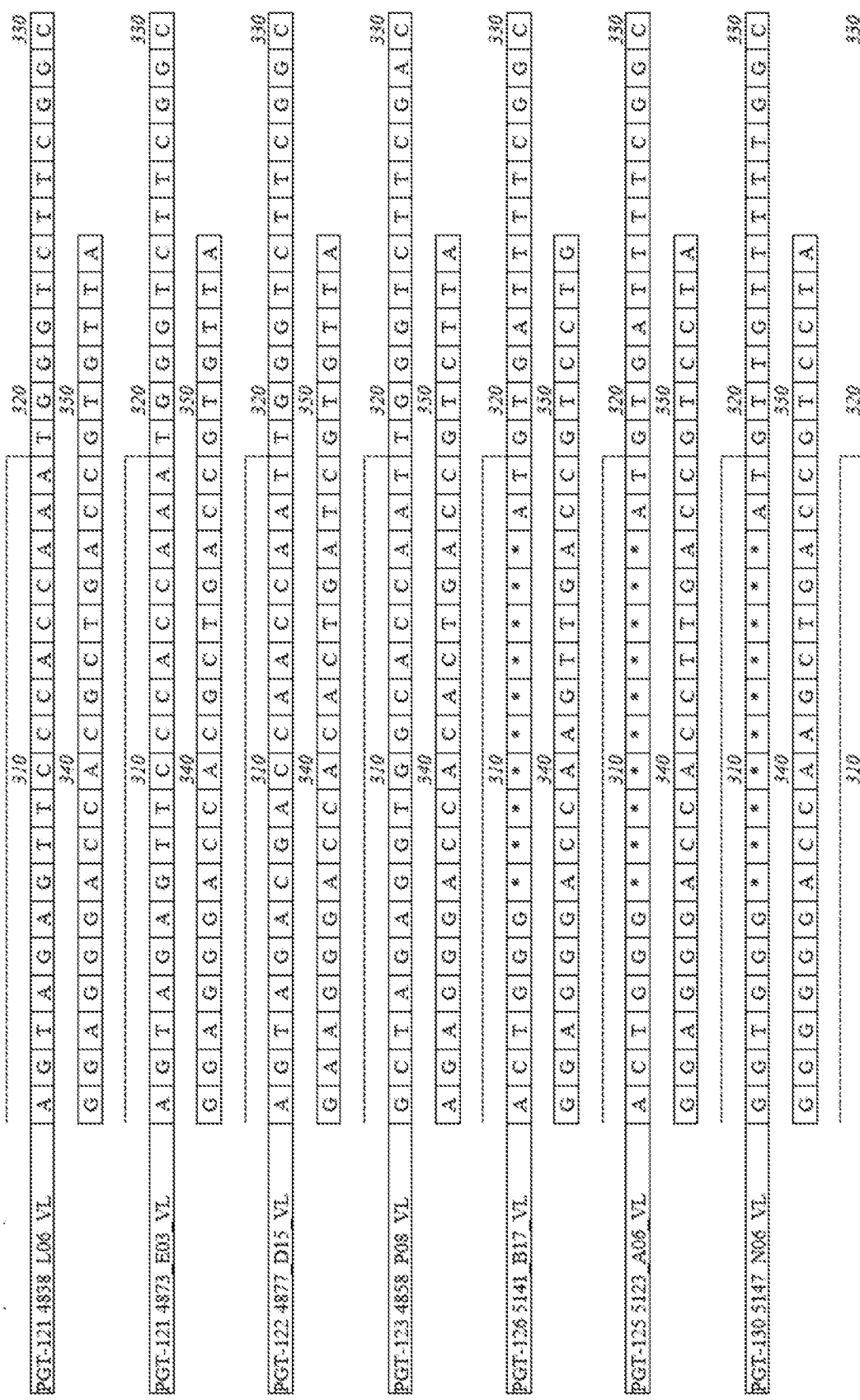
Figure 51:
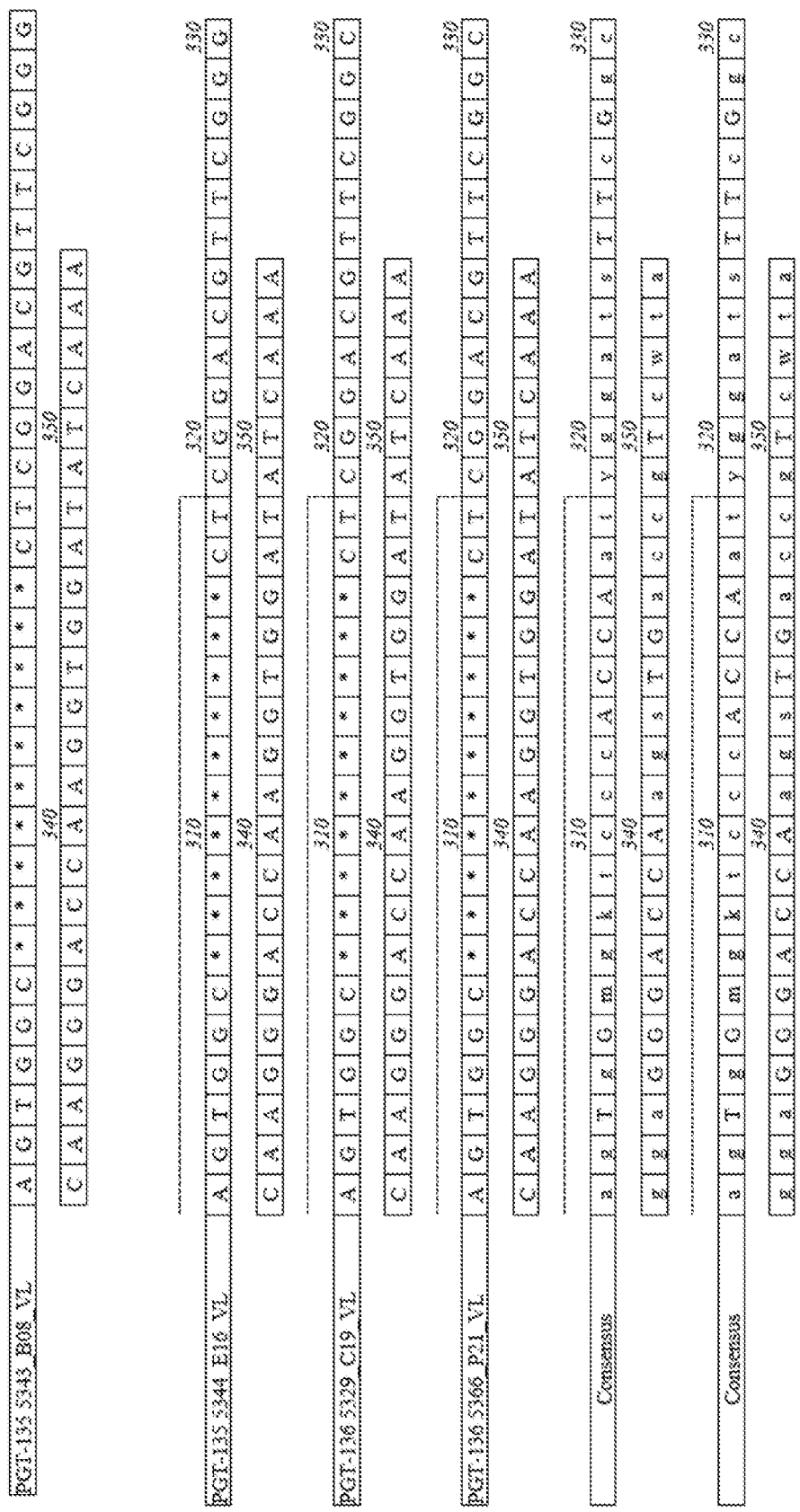

FIG. 51 is an alignment of light chain variable gene alignment for PGT-121, PGT-122, PGT-123, PGT-125, PGT-126, PGT-130, PGT-135, and PGT-136.

Figure 52:
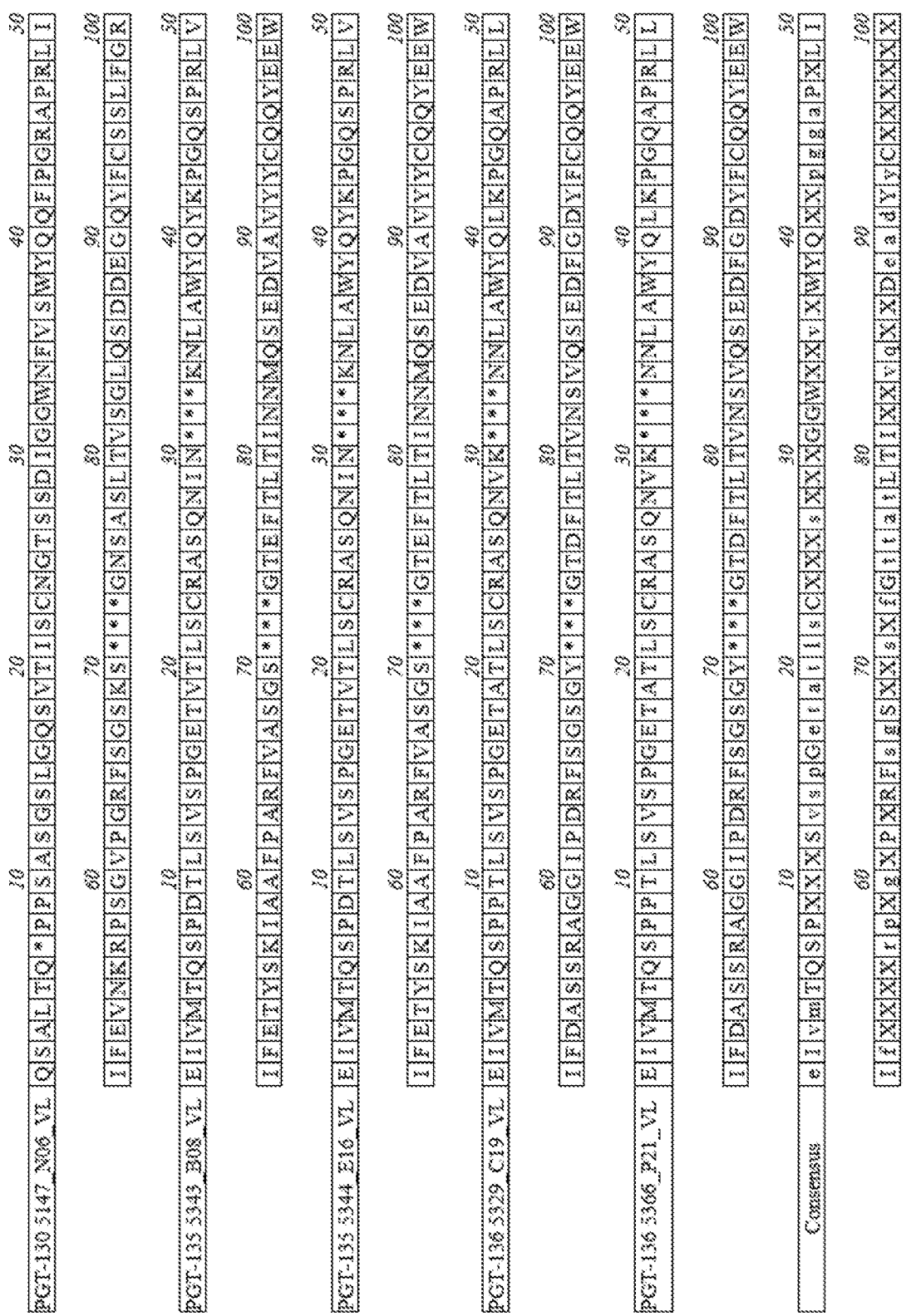

FIG. 52 is an alignment of light chain variable protein alignment for PGT-121, PGT-122, PGT-123, PGT-125, PGT-126, PGT-130, PGT-135, and PGT-136.

Figure 53:
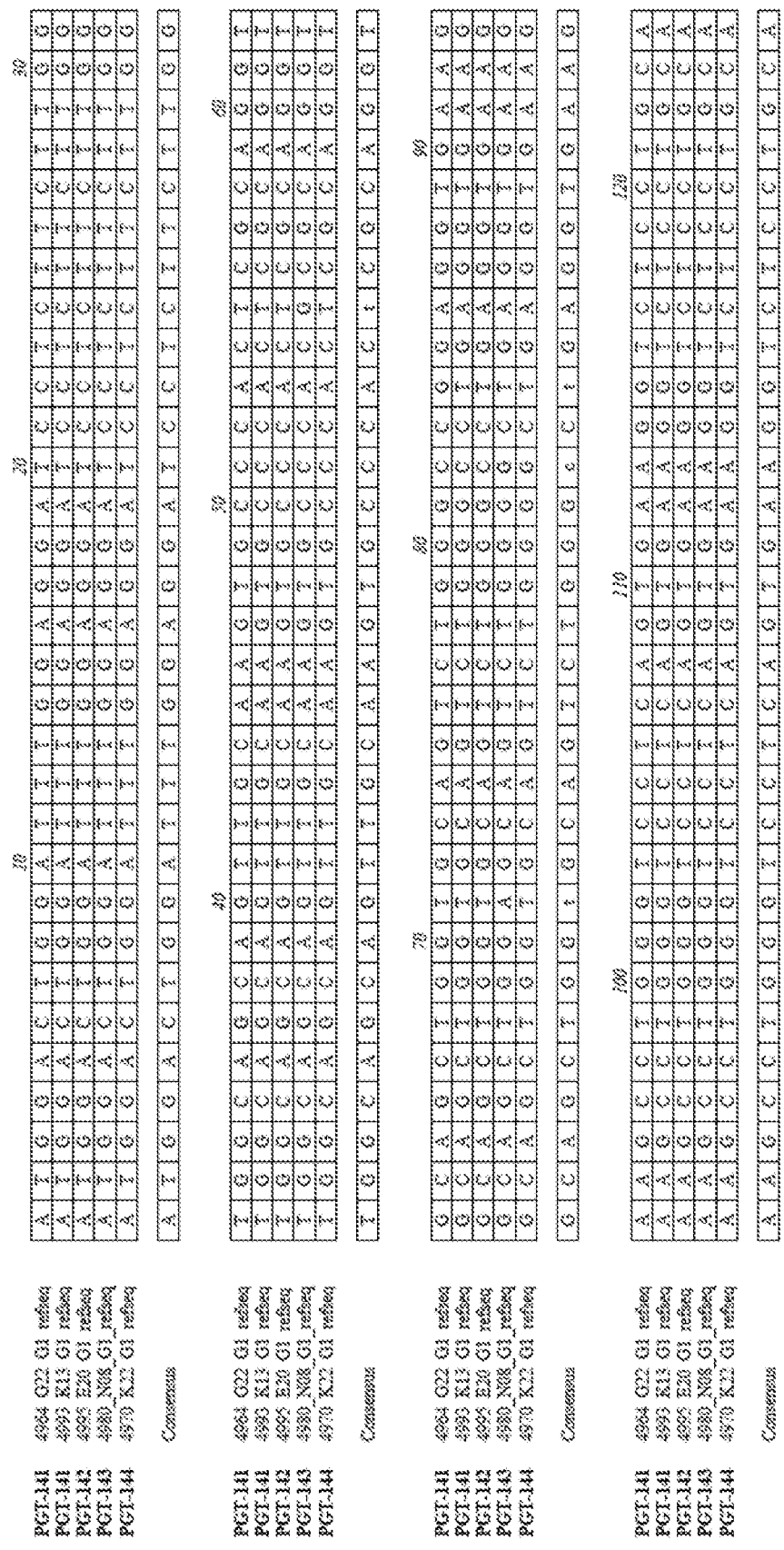
Figure 53:
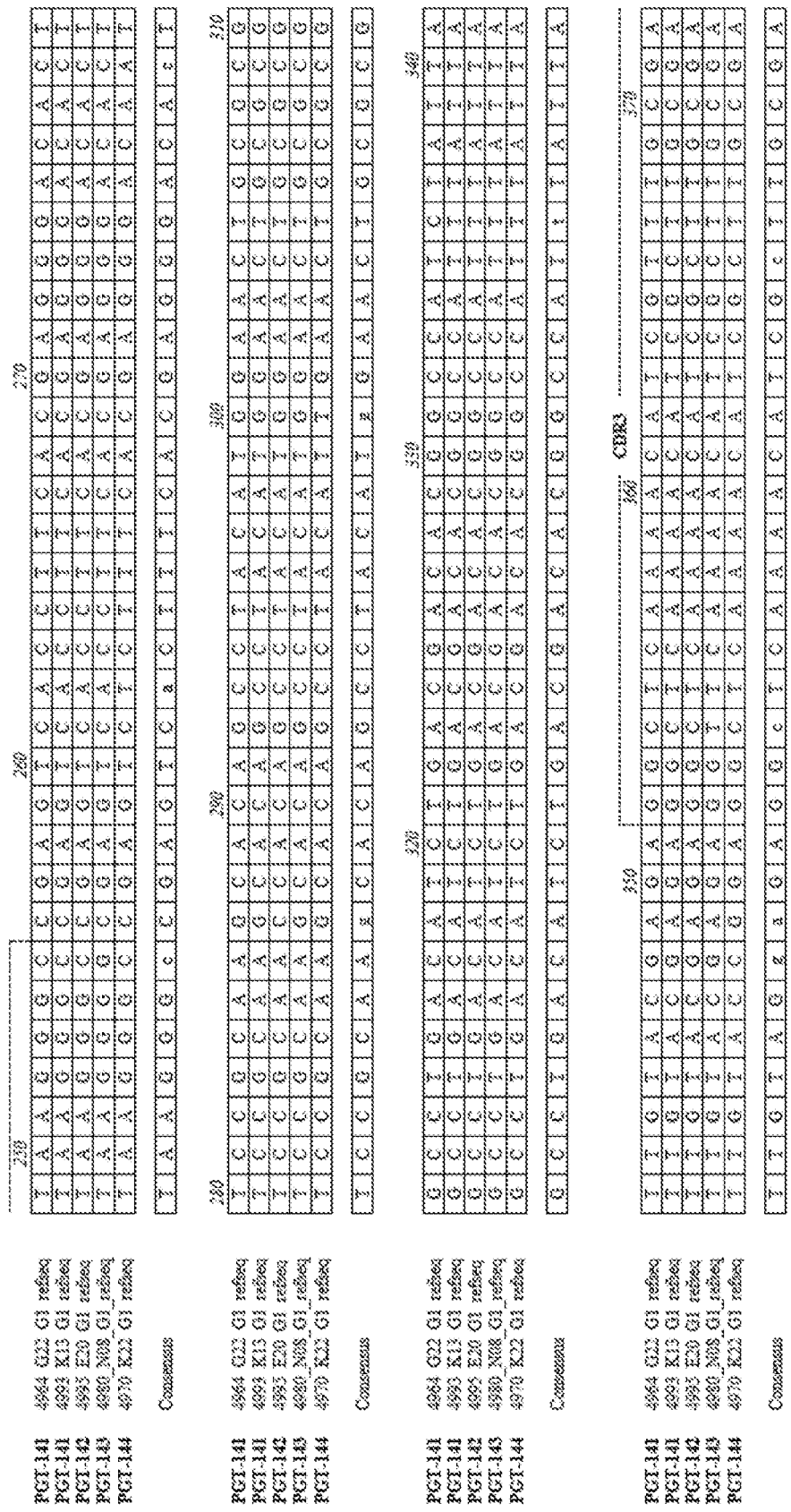

FIG. 53 is an alignment of heavy chain variable gene alignment for PGT-141, PGT-142, PGT-143, and PGT-144.

FIG. 54 is an alignment of heavy chain variable protein alignment for PGT-141, PGT-142, PGT-143, and PGT-144.

Figure 55:
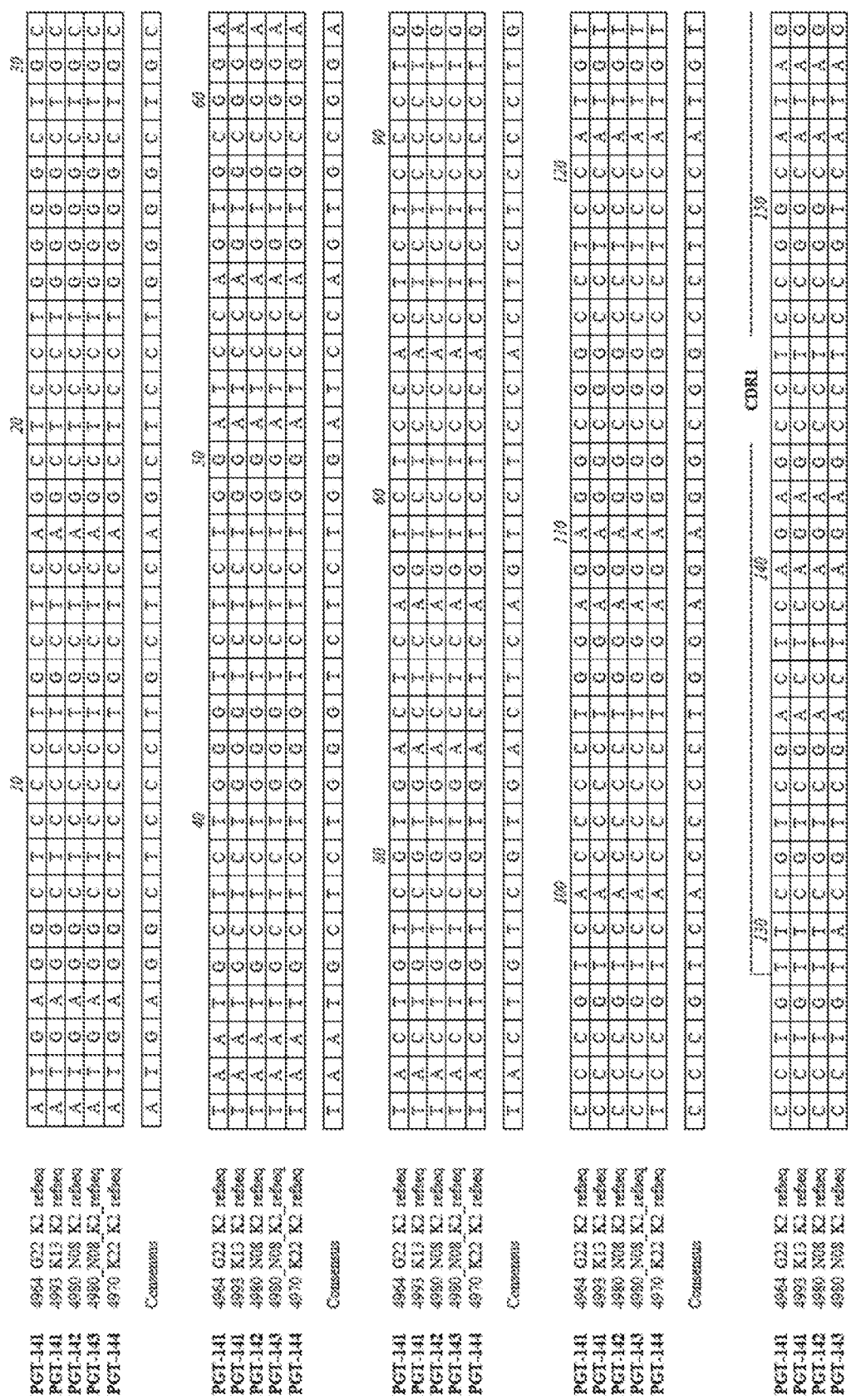

FIG. 55 is an alignment of light chain variable gene alignment for PGT-141, PGT 142, PGT-143, and PGT-144.

Figure 56:
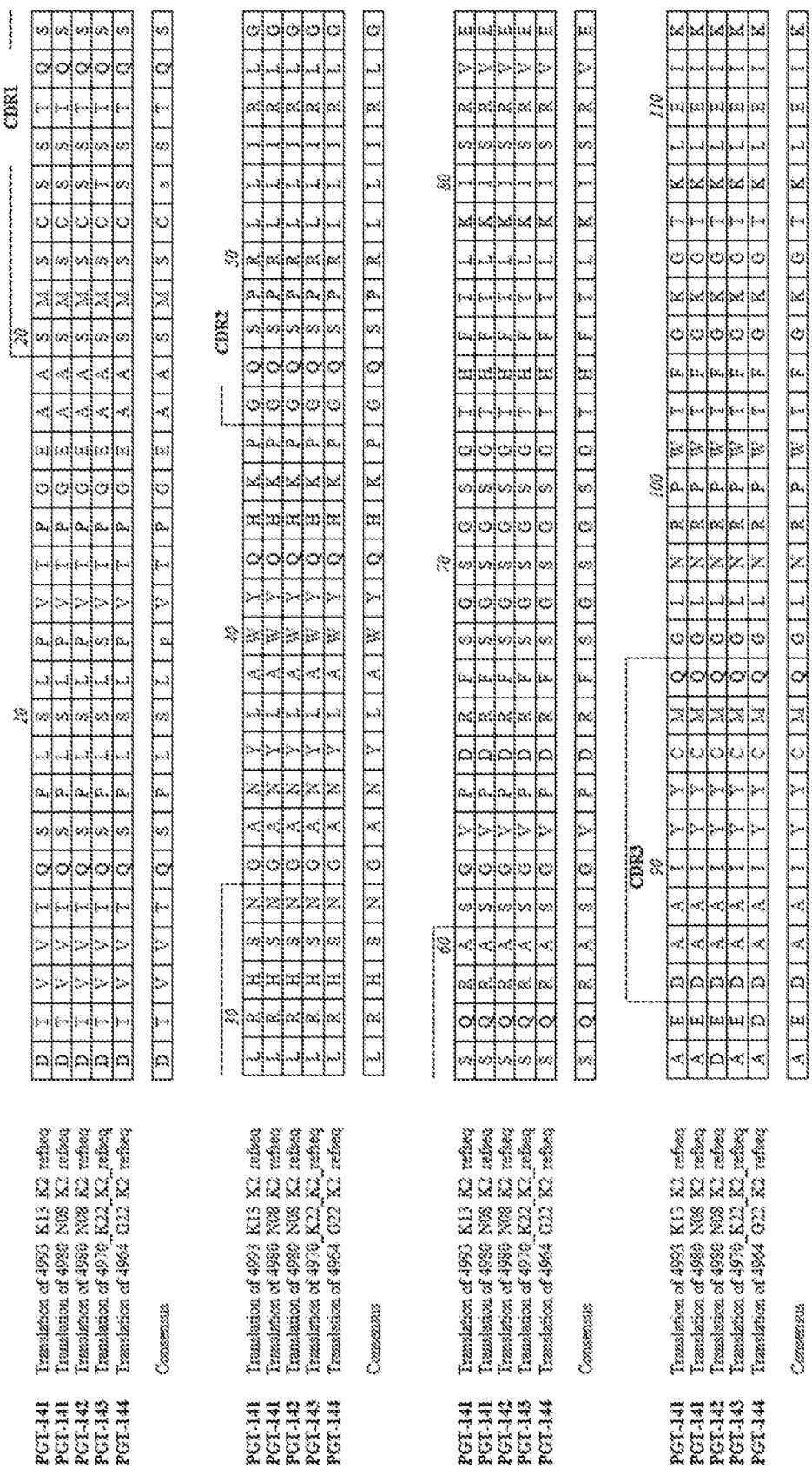

FIG. 56 is an alignment of light chain variable protein alignment for PGT-141, PGT 142, PGT-143, and PGT-144.

DETAILED DESCRIPTION OF THE INVENTION

In the sera of human immunodeficiency virus type 1 (HIV-1) infected patients, anti-virus antibodies can be detected over a certain period after infection without any clinical manifestations of the acquired immunodeficiency syndrome (AIDS). At this state of active immune response, high numbers of antigen-specific B-cells are expected in the circulation. These B-cells are used as fusion partners for the generation of human monoclonal anti-HIV antibodies. One major drawback to finding a vaccine composition suitable for more reliable prevention of human individuals from HIV-1 infection and/or for more successful therapeutic treatment of infected patients is the ability of the HIV-1 virus to escape antibody capture by genetic variation, which very often renders the remarkable efforts of the researchers almost useless. Such escape mutants may be characterized by a change of only one or several of the amino acids within one of the targeted antigenic determinants and may occur, for example, as a result of spontaneous or induced mutation. In addition to genetic variation, certain other properties of the HIV-1 envelope glycoprotein makes it difficult to elicit neutralizing antibodies making generation of undesirable non-neutralizing antibodies a major concern (see, Phogat S K and Wyatt R T, Curr Pharm Design 2007; 13(2):213-227).

HIV-1 is among the most genetically diverse viral pathogens. Of the three main branches of the HIV-1 phylogenetic tree, the M (main), N (new), and O (outlier) groups, group M viruses are the most widespread, accounting for over 99% of global infections. This group is presently divided into nine distinct genetic subtypes, or clades (A through K), based on full-length sequences. Env is the most variable HIV-1 gene, with up to 35% sequence diversity between clades, 20% sequence diversity within clades, and up to 10% sequence diversity in a single infected person (Shankarappa, R. et al. 1999. J. Virol. 73:10489-10502). Clade B is dominant in Europe, the Americas, and Australia. Clade C is common in southern Africa, China, and India and presently infects more people worldwide than any other clade (Mc-Cutchan, F E. 2000. Understanding the genetic diversity of HIV-1. AIDS 14(Suppl. 3):531-S44). Clades A and D are prominent in central and eastern Africa.

Neutralizing antibodies (NAbs) against viral envelope proteins (Env) provide adaptive immune defense against human immunodeficiency virus type 1 (HIV-1) exposure by blocking the infection of susceptible cells (Kwong P D et al., 2002. Nature 420: 678-682). The efficacy of vaccines against several viruses has been attributed to their ability to elicit NAbs. However, despite enormous efforts, there has been limited progress toward an effective immunogen for HIV-1. (Burton, D. R. 2002. Nat. Rev. Immunol. 2:706-713).

HIV-1 has evolved with an extensive array of strategies to evade antibody-mediated neutralization. (Barouch, D. H. Nature 455, 613-619 (2008); Kwong, P. D. & Wilson, I. A. Nat Immunol 10, 573-578 (2009); Karlsson Hedestam, G. B., et al. Nat Rev Microbiol 6, 143-155 (2008)). However, broadly neutralizing antibodies (bNAbs) develop over time in a proportion of HIV-1 infected individuals. (Leonidas Stamatatos, L. M., Dennis R Burton, and John Mascola. Nature Medicine (E-Pub: Jun. 14, 2009); PMID: 19525964.) A handful of broadly neutralizing monoclonal antibodies have been isolated from clade B infected donors. (Burton, D. R., et al. Science 266, 1024-1027 (1994); Trkola, A., et al. J Virol 69, 6609-6617 (1995); Stiegler, G., et al. AIDS Res Hum Retroviruses 17, 1757-1765 (2001)). These antibodies tend to display less breadth and potency against non-clade B viruses, and they recognize epitopes on the virus that have so far failed to elicit broadly neutralizing responses when incorporated into a diverse range of immunogens. (Phogat, S. & Wyatt, R. Curr Pharm Design 13, 213-227 (2007); Montero, M., van Houten, N. E., Wang, X. & Scott, J. K. Microbiol Mol Biol Rev 72, 54-84, table of contents (2008); Scanlan, C. N., Offer, J., Zitzmann, N. & Dwek, R. A. Nature 446, 1038-1045 (2007)). Despite the enormous diversity of the human immunodeficiency virus (HIV), all HIV viruses known to date interact with the same cellular receptors (CD4 and/or a co-receptor, CCR5 or CXCR4). Most neutralizing antibodies bind to functional regions involved in receptor interactions and cell membrane fusion. However, the vast majority of neutralizing antibodies isolated to date do not recognize more than one clade, therefore exhibiting limited protective efficacy in vitro or in vivo. (See Binley J M et al., 2004. J. Virol. 78(23):13232-13252). The rare broadly neutralizing human monoclonal antibodies (mAbs) that have been isolated from HIV+ clade B-infected human donors bind to products of the env gene of HIV-1, gp120 and the transmembrane protein gp41. (Parren, P W et al. 1999. AIDS 13:S137-S162). However, a well-known characteristic of the HIV-1 envelope glycoprotein is its extreme variability. It has been recognized that even relatively conserved epitopes on HIV-1, such as the CD4 binding site, show some variability between different isolates (Poignard, P., et al., Ann. Rev. Immunol. (2001) 19:253-274). Even an antibody targeted to one of these conserved sites can be expected to suffer from a reduced breadth of reactivity across multiple different isolates.

The few cross-clade reactive monoclonal antibodies known to date have been isolated by processes involving generation of panels of specific viral antibodies from peripheral blood lymphocytes (PBLs) of HIV-infected individuals, either via phage display, or via conventional immortalization techniques such as hybridoma or Epstein Barr virus transformation, electrofusion and the like. These are selected based on reactivity in vitro to HIV-1 proteins, followed by testing for HIV neutralization activity.

An antibody phage surface expression system was used to isolate the cross-clade neutralizing Fab (fragment, antigen binding) b12 occurring in a combinatorial library. The Fab b12 was screened by panning for envelope glycoprotein gp120 binding activity and neutralizing activity against the HIV-1 (HXBc2) isolate was observed. (Roben P et al., J. Virol. 68(8): 4821-4828(1994); Barbas C F et al., Proc. Natl. Acad. Sci. USA Vol. 89, pp. 9339-9343, (1992); Burton D P et al., Proc. Natl. Acad. Sci. USA Vol. 88, pp. 10134-10137 (1991)).

Human B cell immortalization was used to isolate the cross-clade neutralizing monoclonal antibodies 2G12, 2F5, and 4E10 from HIV-infected individuals. The monoclonal antibody 2G12 binds to a glycotope on the gp120 surface glycoprotein of HIV-1 and had been shown to display broad neutralizing patterns. (Trkola A., et al., J. Virol. 70(2):1100-1108 (1996), Buchacher, A., et al., 1994. AIDS Res. Hum. Retroviruses 10:359-369). The monoclonal antibody 2F5 which had been shown to bind a sequence within the external domain of the gp41 envelope glycoprotein of HIV-1 was found to have broad neutralization properties. (Conley A J Proc. Natl. Acad. Sci. USA Vol. 91, pp. 3348-3352 (1994); Muster T et al., J. Virol. 67(11):6642-6647 (1993); Buchacher A et al., 1992, Vaccines 92:191-195). The monoclonal antibody 4E10, which binds to a novel epitope C terminal of the ELDKWA sequence in gp41 recognized by 2F5, has also been found to have potent cross-clade neutralization activity. (Buchacher, A., et al., 1994. AIDS Res. Hum. Retroviruses 10:359-369; Stiegler, G., et al., 2001. AIDS Res. Hum. Retroviruses 17(18):1757-1765)).

Other studies on antibody neutralization of HIV-1 (Nara, P. L., et al. (1991) FASEB J. 5:2437-2455.) focused on a single linear epitope in the third hypervariable region of the viral envelope glycoprotein gp120 known as the V3 loop. Antibodies to this loop are suggested to neutralize by inhibiting fusion of viral and cell membranes. However there is sequence variability within the loop and neutralizing antibodies are sensitive to sequence variations outside the loop (Albert J. et al., (1990) AIDS 4, 107-112). Hence anti-V3 loop antibodies are often strain-specific and mutations in the loop in vivo may provide a mechanism for viral escape from antibody neutralization. There is some indication that not all neutralizing antibodies act by blocking the attachment of virus, since a number of mouse monoclonal antibodies inhibiting CD4 binding to gp120 are either non-neutralizing (Lasky L A, et al., (1987) Cell 50:975-985.) or only weakly neutralizing (Sun N., et al., (1989) J. Virol. 63, 3579-3585).

It is widely accepted that such a vaccine will require both T-cell mediated immunity as well as the elicitation of a broadly neutralizing antibody (bNAb) response. (Barouch, D. H. Nature 455, 613-619 (2008); Walker, B. D. & Burton, D. R. Science 320, 760-764 (2008); Johnston, M. I. & Fauci, A. S. N Engl J Med 356, 2073-2081 (2007)). All of the known bNAbs provide protection in the best available primate models (Veazey, R. S., et al. Nat Med 9, 343-346 (2003); Hessell, A. J., et al. PLoS Pathog 5, e1000433 (2009); Parren, P. W., et al. J Virol 75, 8340-8347 (2001); Mascola, J. R. Vaccine 20, 1922-1925 (2002); Mascola, J. R., et al. Nat Med 6, 207-210 (2000); Mascola, J. R., et al. J Virol 73, 4009-4018 (1999)). Therefore, broadly neutralizing antibodies (bNAbs) are considered to be the types of antibodies that should be elicited by a vaccine. Unfortunately, existing immunogens, often designed based on these bNAbs, have failed to elicit NAb responses of the required breadth and potency. Therefore, it is of high priority to identify new bNAbs that bind to epitopes that may be more amenable to incorporation into immunogens for elicitation of NAb responses.

The present invention provides a novel method for isolating novel broad and potent neutralizing monoclonal antibodies against HIV. The method involves selection of a PBMC donor with high neutralization titer of antibodies in the plasma. B cells are screened for neutralization activity prior to rescue of antibodies. Novel broadly neutralizing antibodies are obtained by emphasizing neutralization as the initial screen.

The invention relates to potent, broadly neutralizing antibody (bNAb) wherein the antibody neutralizes HIV-1 species belonging to two or more clades, and further wherein the potency of neutralization of at least one member of each clade is determined by an IC50 value of less than 0.2 µg/mL. In some aspects, the clades are selected from Clade A, Clade B, Clade C, Clade D and Clade AE. In some aspects, the HIV-1 belonging two or more clades are non-Clade B viruses. In some aspects, the broadly neutralizing antibody neutralizes at least 60% of the HIV-1 strains listed in Tables 18A-18F. In some embodiments, at least 70%, or at least 80%, or at least 90% of the HIV-1 strains listed in Tables 18A-18F are neutralized.

The invention relates to potent, broadly neutralizing antibody (bNAb) wherein the antibody neutralizes HIV-1 species with a potency of neutralization of at least a plurality of HIV-1 species with an IC50 value of less than 0.2 µg/mL. In some embodiments the potency of neutralization of the HIV-1 species has an IC50 value of less than 0.15 µg/mL, or less than 0.10 µg/mL, or less than 0.05 µg/mL. In some aspects, a potent, broadly neutralizing antibody is defined as a bNAb that displays a potency of neutralization of at least a plurality of HIV-1 species with an IC90 value of less than 2.0 µg/mL. In some embodiments the potency of neutralization of the HIV-1 species has an IC90 value of less than 1.0 µg/mL, or less than 0.5 µg/mL.

Figure 4:
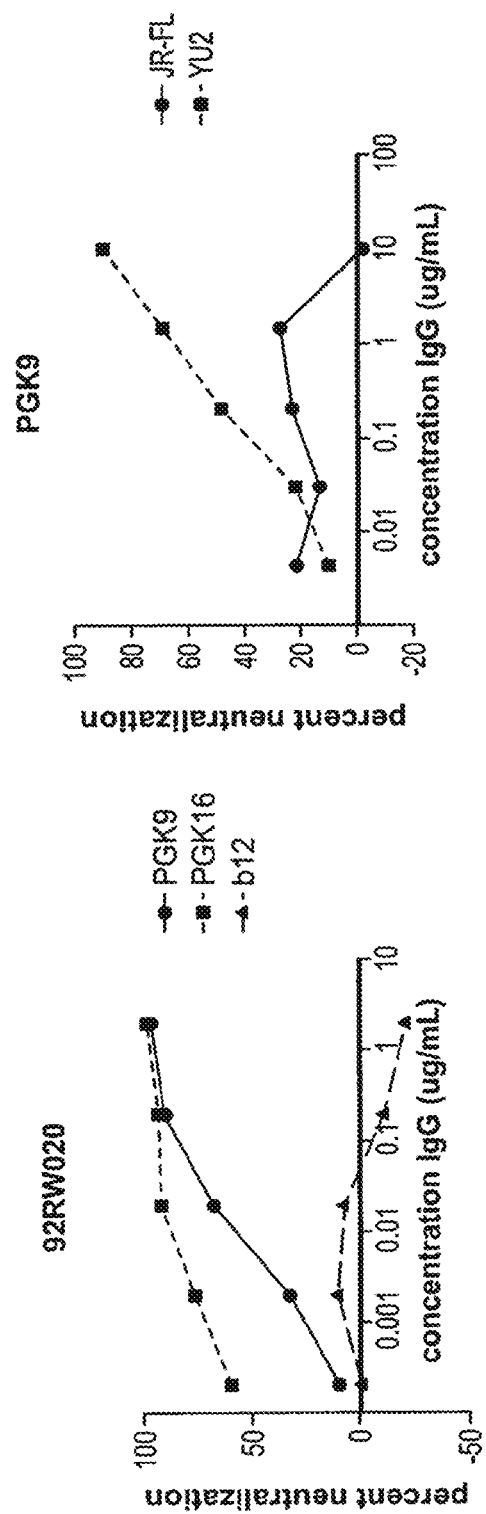
FIG. 4 is a series of graphs depicting the neutralization activity of monoclonal antibodies 1443_C16 (PG16) and 1496_C09 (PG9) to additional pseudoviruses not included in Tables 17A and 17B.

An exemplary method is illustrated in the schematic shown in FIG. 4. Peripheral Blood Mononuclear Cells (PBMCs) were obtained from an HIV-infected donor selected for HIV-1 neutralizing activity in the plasma. Memory B cells were isolated and B cell culture supernatants were subjected to a primary screen of neutralization assay in a high throughput format. Optionally, HIV antigen binding assays using ELISA or like methods were also used as a screen. B cell lysates corresponding to supernatants exhibiting neutralizing activity were selected for rescue of monoclonal antibodies by standard recombinant methods.

In one embodiment, the recombinant rescue of the monoclonal antibodies involves use of a B cell culture system as described in Weitcamp J-H et al., J. Immunol. 171:4680-4688 (2003). Any other method for rescue of single B cells clones known in the art also may be employed such as EBV immortalization of B cells (Traggiai E., et al., Nat. Med. 10(8):871-875 (2004)), electrofusion (Buchacher, A., et al., 1994. AIDS Res. Hum. Retroviruses 10:359-369), and B cell hybridoma (Karpas A. et al., Proc. Natl. Acad. Sci. USA 98:1799-1804 (2001).

In some embodiments, monoclonal antibodies were rescued from the B cell cultures using variable chain gene-specific RT-PCR, and transfectant with combinations of H and L chain clones were screened again for neutralization and HIV antigen binding activities. mAbs with neutralization properties were selected for further characterization.

A novel high-throughput strategy was used to screen IgG-containing culture screening supernatants from approximately 30,000 activated memory B cells from a clade A infected donor for recombinant, monomeric gp120JR-CSF and gp41HxB2 (Env) binding as well as neutralization activity against HIV-1JR-CSF and HIV-1SF162 (See Table 1).

TABLE 1

| Memory B cell Screening. | |
|---|---|
| Total number of wells screened | 23,328 |
| Number of sIgG$^+$ memory B cells screened | 30,300 |
| gp120 ELISA hits | 411 (1.36%) |
| gp41 ELISA hits | 167 (0.55%) |
| SF162 neutralization hits | 401 (1.32%) |
| JR-CSF neutralization hits | 401 (1.32%) |

Figure 2:
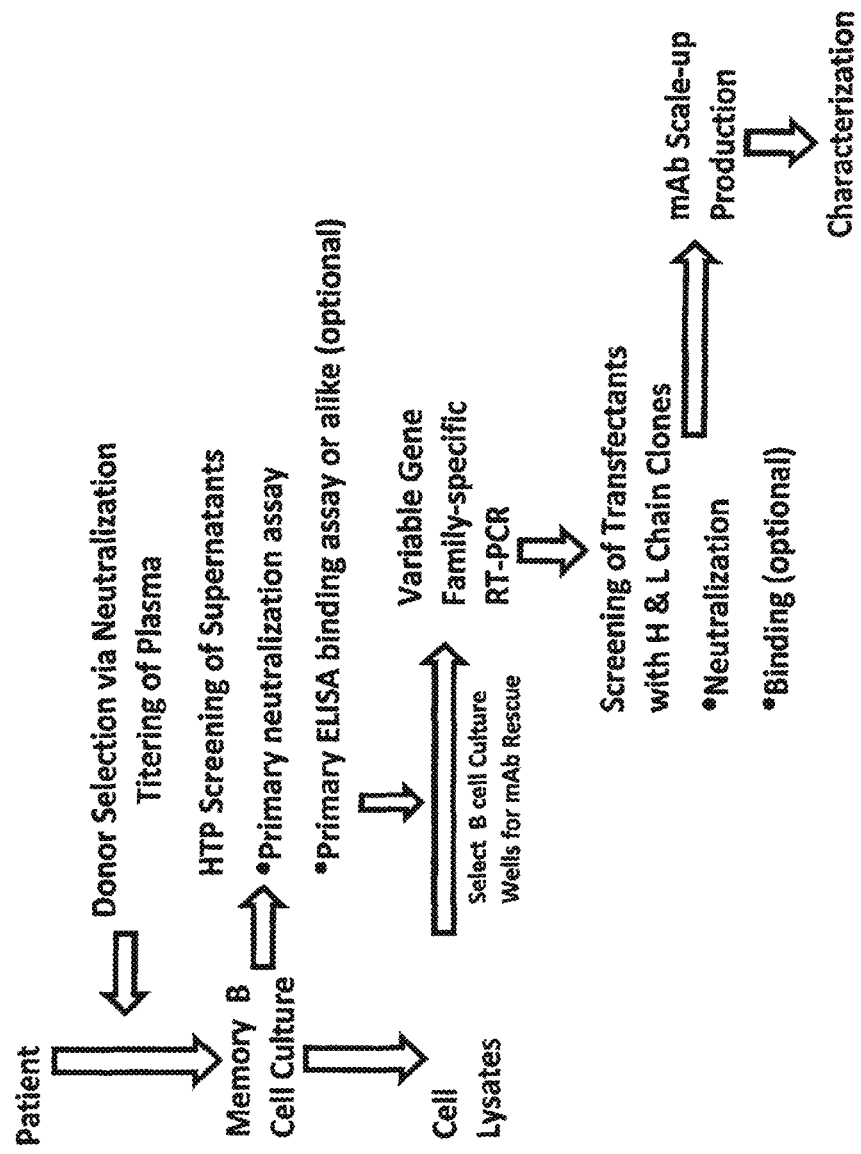
FIG. 2 is a flow chart of the process for isolation of monoclonal antibodies according to the invention.
Figure 3A:
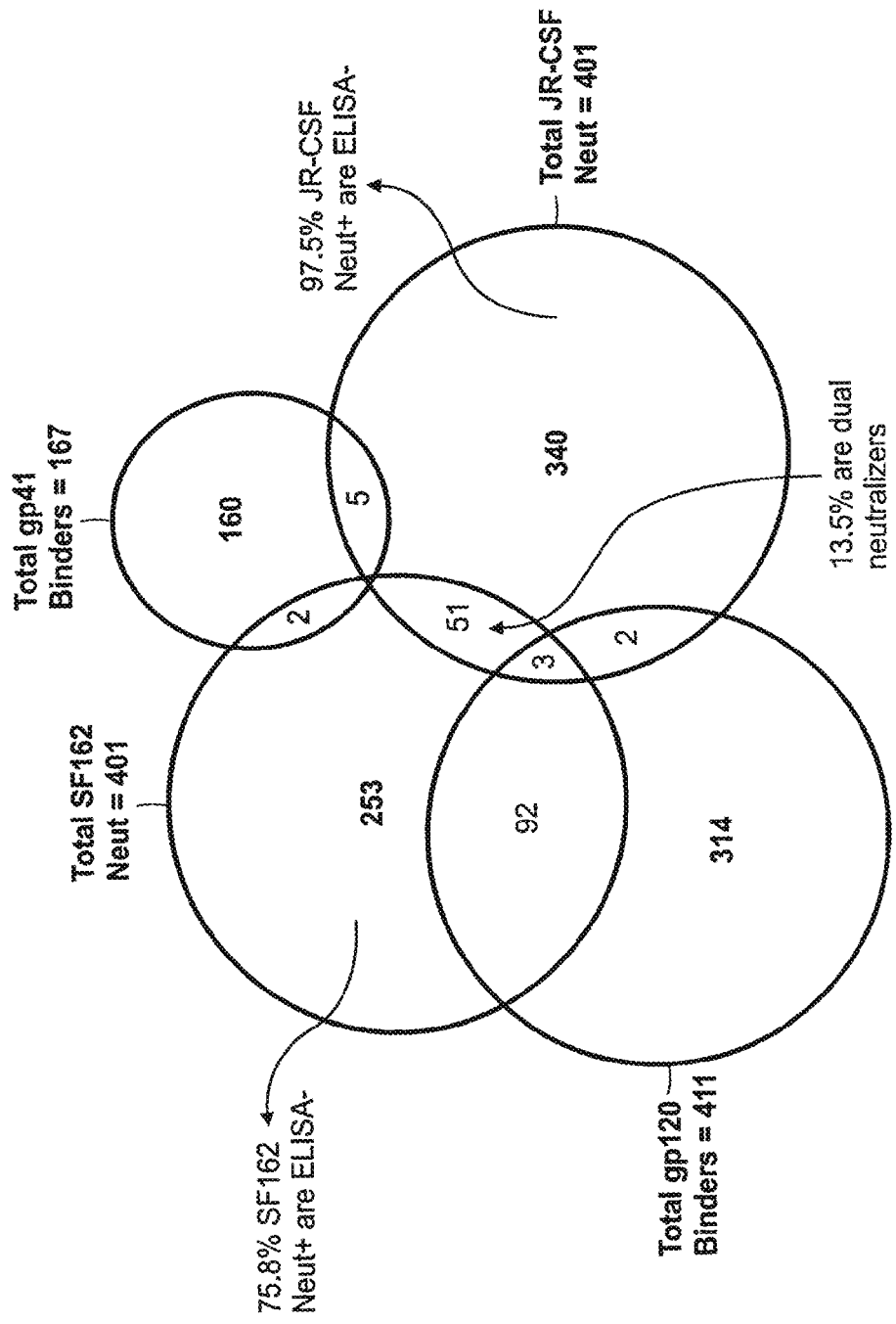
FIG. 3A is a schematic diagram that summarizes the screening results for neutralization and HIV-env protein (gp120 and gp41) binding assays from which B cell cultures were selected for antibody rescue and the monoclonal antibodies 1496_C09 (PG9), 1443_C16 (PG16), 1456_P20 (PG20), 1460_G14 (PGG14), and 1495_C14 (PGC14) were derived. A neutralization index value of 1.5 was used as a cut-off.
Figure 3B:
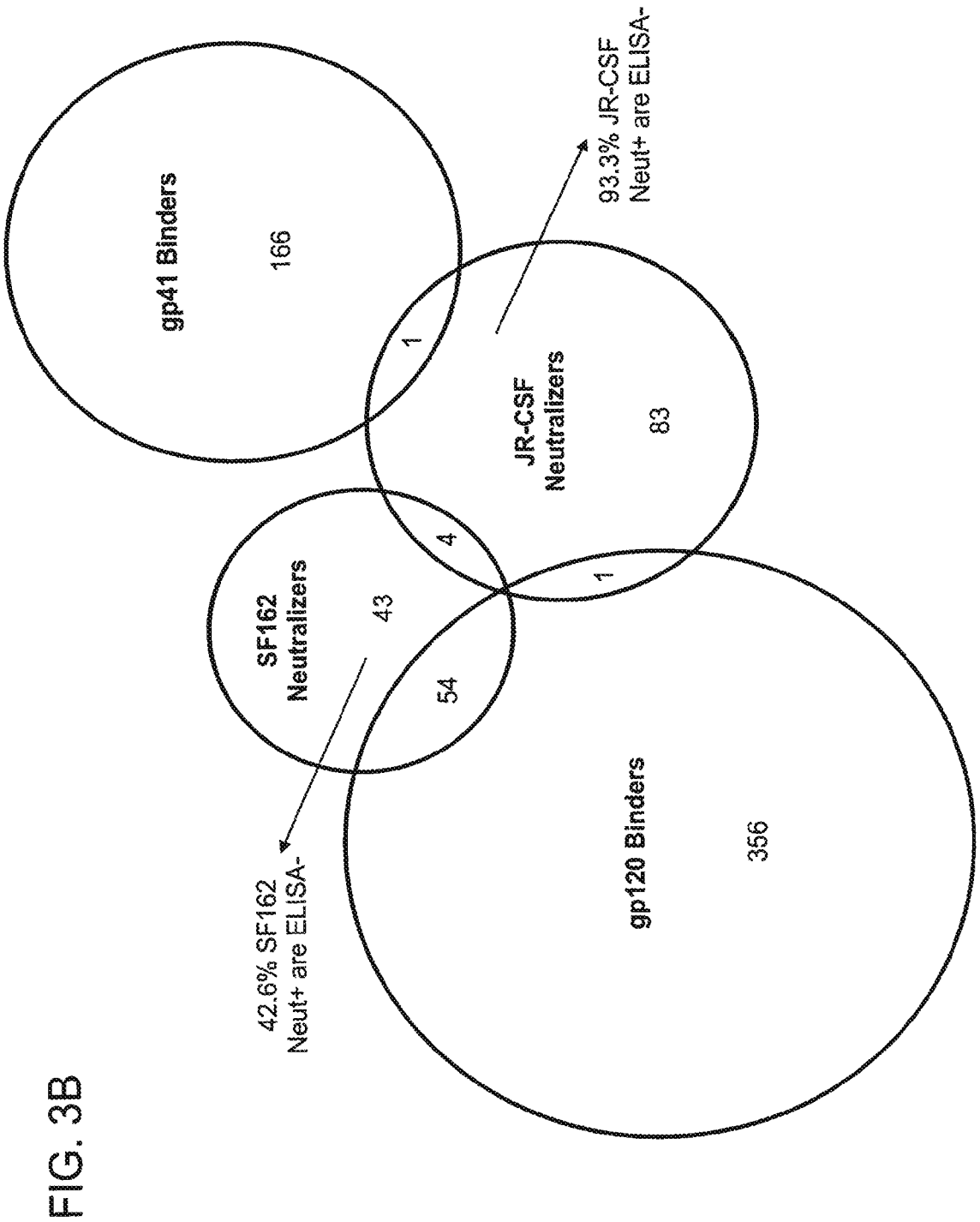
FIG. 3B is a schematic diagram that summaries the neutralizing activity and HIV-env protein (gp120 and gp41) binding activities of the monoclonal antibodies 1496_C09 (PG9), 1443_C16 (PG16), 1456_P20 (PG20), 1460_G14 (PGG14), and 1495_C14 (PGC14) as determined by ELISA assays among the B cell supernatants using a neutralization index cut-off value of 2.0. The neutralization index was expressed as the ratio of normalized relative luminescence units (RLU) of SIVmac239 to that of test viral strain derived from the same test B cell culture supernatant. The cut-off values used to distinguish neutralizing hits were determined by the neutralization index of a large number of negative control wells containing B cell culture supernatants derived from healthy donors.

Unexpectedly, a large proportion of the B cell supernatants that neutralized HIV-1JR-CSF did not bind monomeric gp120JR-CSF or gp41HxB2, and there were only a limited number of cultures that neutralized both viruses (FIG. 3B). Antibody genes were rescued from five B cell cultures selected for differing functional profiles; one bound to gp120 and only neutralized HIV-1SF162, two bound to gp120 and weakly neutralized both viruses, and two potently neutralized HIV-1JR-CSF, failed to neutralize HIV-1SF162, and did not bind to monomeric gp120 or gp41. Five antibodies identified according to these methods are disclosed herein. The antibodies were isolated from a human sample obtained through International AIDS Vaccine Initiative's (IAVI's) Protocol G, and are produced by the B cell cultures referred to as 1443_C16 (PG16) (TCN-116), 1503 H05 (PG16) (TCN-119), 1456 A12 (PG16) (TCN-117), 1469 M23 (PG16) (TCN-118), 1489 I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158). Antibodies referred to as 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT- 158), were isolated from the corresponding B cell cultures. These antibodies have been shown to neutralize HIV in vitro.

Analysis of the antibody variable genes revealed that two antibody pairs were related by somatic hypermutation and that two of the somatic variants contained unusually long CDRH3 loops (Table 2). Long CDRH3 loops have previously been associated with polyreactivity. (Ichiyoshi, Y. & Casali, P. J Exp Med 180, 885-895 (1994)). The antibodies were tested against a panel of antigens and the antibodies were confirmed to be not polyreactive.

TABLE 2

Sequence Analysis of mAb Variable Genes

| Clone | Germline IGVL[a] | Germline IGVH[a] | CDRL3[b] | SEQ ID NO: | CDRH3[b] | SEQ ID NO: |
|---|---|---|---|---|---|---|
| PG16 | VL2-14*01 | VH3-33*05 | SSLTDRSHRIF | 1 | EAGGPIWHDDVKYYDFNDGYYNYHYMDV | 6 |
| PG9 | VL2-14*01 | VH3-33*05 | KSLTSTRRRVF | 2 | EAGGPDYRNGYNYYDFYDGYYNYHYMDV | 7 |
| PGG14 | VK1-39*01 | VH1-69*12 | SYSTPRTF | 3 | DRRVVPMATDNWLDP | 8 |
| PG20 | VK2-14*01 | VH1-69*12 | SFSTPRTF | 4 | DRRAVPIATDNWLDP | 9 |
| PGC14 | VL3-1*01 | VH1-24*01 | AWETTTTFVFF | 5 | GAVGADSGSWFDP | 10 |

[a]Germ line gene sequences were determined using the IMGT database, which is publicly available at imgt.cinesfr. "L" and "K" refer to lambda and kappa chains, respectively,
[b]Bolded amino acids denote differences between somatic variants.

TABLE 3A

Heavy Chain Gene Usage Summary

| mAb ID | mAb Specificity | V-Gene & allele | V-Gene identity | J-Gene & allele | J-Gene identity | CDR3 |
|---|---|---|---|---|---|---|
| 1443_C16 | ELISA-negative | IGHV3-33*05 | 85.07% (245/288 nt) | IGHJ6*03 | 85.48% (53/62 nt) | AREAGGPIWHDDVKYYDFNDGYYNYHYMDV (SEQ ID NO: 46) |
| 1456_P20 | gp120 | IGHV1-69*11 or IGHV1-69*12 | 85.07% (245/288 nt) | IGHJ5*02 | 88.24% (45/51 nt) | ARDRRAVPIATDNWLDP (SEQ ID NO: 47) |
| 1460_G14 | gp120 | IGHV1-69*11 or IGHV1-69*12 | 86.11% (248/288 nt) | IGHJ5*02 | 86.27% (44/51 nt) | TRDRRVVPMATDNWLDP (SEQ ID NO: 48) |
| 1495_C14 | gp120 | IGHV1-f*01 | 88.89% (256/288 nt) | IGHJ5*02 | 84.31% (43/51 nt) | AAGAVGADSGSWFDP (SEQ ID NO: 49) |
| 1496_C09 | ELISA-negative | IGHV3-33*05 | 85.07% (245/288 nt) | IGHJ6*03 | 83.87% (52/62 nt) | VREAGGPDYRNGYNYYDFYDGYYNYHYMDV (SEQ ID NO: 50) |

TABLE 3B

Light Chain Gene Usage Summary

| mAb ID | mAb Specificity | V-Gene and allele | V-gene identity | J-GENE and allele | J-Gene identity | CDR3 | SEQ ID NO: |
|---|---|---|---|---|---|---|---|
| 1443_C16 | ELISA-negative | IGLV2-14*01 | 88.19% (254/288 nt) | IGLJ2*01. or IGLJ3*01 or IGLJ3*02 | 83.33% (30/36 nt) | SSLTDRSHRI | 41 |
| 1456_P20 | gp120 | IGKV1-39*01, or | 92.11% (257/279 | IGKJ5*01 | 92.11% (35/38 | QQSFSTPRT | 42 |

TABLE 3B-continued

Light Chain Gene Usage Summary

| mAb ID | mAb Specificity | V-Gene and allele | V-gene identity | J-GENE and allele | J-Gene identity | CDR3 | SEQ ID NO: |
|---|---|---|---|---|---|---|---|
| | | IGKV1D-39*01 | nt) | | nt) | | |
| 1460_C14 | gp120 | IGKV1-39*01, or IGKV1D-39*01 | 92.11% (257/279 nt) | IGKJ5*01 | 89.47% (34/38 nt) | QQSYSTPRT | 43 |
| 1495_C14 | gp120 | IGLV3-1*01 | 88.89% (248/279 nt) | IGLJ2*01. or IGLJ3*01 | 86.84% (33/38 nt) | QAWETTTTT FVF | 44 |
| 1496_C09 | ELISA-negative | IGLV2-14*01 | 91.32% (263/288 nt) | IGLJ3*02 | 86.11% (31/36 nt) | KSLTSTRRRV | 45 |

The broadly neutralizing antibodies from 1443_C16 (PG16) and 1496_C09 (PG9) clones obtained by this method did not exhibit soluble gp120 or gp41 binding at levels that correlate with neutralization activity. The method of the invention therefore allows identification of novel antibodies with broad cross-clade neutralization properties regardless of binding activities in an ELISA screen. Further characterization of PG16 and PG9 is disclosed herein.

All five antibodies were first tested for neutralization activity against a multi-clade 16-pseudovirus panel (Table 4). Two of the antibodies that bound to monomeric gp120 in the initial screen (PGG14 and PG20) did not show substantial neutralization breadth or potency against any of the viruses tested, and the third antibody that bound to gp120 (PGC14) neutralized 4/16 viruses with varying degrees of potency. In contrast, the two antibodies that failed to bind recombinant Env in the initial screen (PG9 and PG16) neutralized a large proportion of the viruses at sub-microgram per ml concentrations. PG9 and PG16 neutralized non-clade B viruses with greater breadth than three out of the four existing bNAbs. This is significant considering that the majority of HIV-1 infected individuals worldwide are infected with non-clade B viruses.

TABLE 4

Neutralization Profiles of Rescued mAbs

| | | IC50 (µg/mL) | | | | |
|---|---|---|---|---|---|---|
| | Isolate | PGC14 | PG9 | PG16 | PGG14 | P20 |
| Clade A | 94UG103 | >50 | 0.17 | 0.008 | >50 | >50 |
| | 92RW020 | 28.60 | 0.06 | 0.004$^a$ | >50 | 50 |
| | 93UG077 | >50 | >50 | >50 | >50 | >50 |
| Clade B | 92BR020 | 0.64 | >50 | >50 | >50 | >50 |
| | APV-13 | >50 | >50 | >50 | >50 | >50 |
| | JRCSF | >50 | <0.0025 | <0.0025 | >50 | >50 |
| | APV-17 | >50 | 26.45 | >50 | >50 | >50 |
| | APV-6 | 7.41 | 0.09 | 0.08$^a$ | >50 | 25.770 |
| Clade C | 93IN905 | >50 | N/A | 0.10$^a$ | >50 | >50 |
| | IAVI-C18 | >50 | 0.05 | 0.007 | >50 | >50 |
| | IAVI-C22 | >50 | N/A | 0.069$^a$ | >50 | >50 |
| | IAVI-C3 | 9.50 | 12.91 | 14.80 | >50 | >50 |
| Clade D | 92UG024 | >50 | 10.96 | >50 | >50 | >50 |
| | 92UG005 | >50 | >50 | >50 | >50 | >50 |
| CRF01_AE | 92TH021 | >50 | 0.11 | 0.13$^a$ | >50 | >50 |
| | CMU02 | >50 | >50 | >50 | >50 | >50 |

TABLE 4-continued

Neutralization Profiles of Rescued mAbs

| | IC50 (µg/mL) | | | | |
|---|---|---|---|---|---|
| Isolate | PGC14 | PG9 | PG16 | PGG14 | P20 |
| negative aMLV control | >50 | >50 | >50 | >50 | >50 |

$^a$Plateau observed in curve.

Table 17A shows neutralization profiles (IC50 values) of monoclonal antibodies 1443_C16 (PG16), 1456_P20 (PG20), 1460_G14 (PGG14), 1495_C14 (PGC14) and 1496_C09 (PG9) and the known cross-clade neutralizing antibodies b12, 2G12, 2F5 and 4E10 on a diverse panel of 16 HIV pseudoviruses from different clades. 1443_C16 (PG16) and 1496_C09 (PG9) neutralize HIV-1 species from Clades A, B, C, D and CRF01_AE with better potency for most viral strains tested than known and generally accepted broad and potent neutralizing antibodies. However, neutralization profiles of individual species of HIV-1 belonging to these clades vary between 1443_C16 (PG16) and 1496_C09 (PG9) and the known cross-clade neutralizing antibodies b12, 2G12, 2F5 and 4E10. 1495_C14 (PGC14) neutralizes fewer HIV-1 species from Clades A, B and C comparable to other neutralizing antibodies. Table 17B shows IC90 values of the monoclonal antibodies 1443_C16 (PG16) and 1496_C09 (PG9) and the known cross-clade neutralizing antibodies b12, 2G12, 2F5 and 4E10 on the same panel of pseudoviruses. FIG. 4 shows neutralization activities of monoclonal antibodies 1443_C16 (PG16) and 1496_C09 (PG9) to six other HIV pseudoviruses (YU2, Bal, ADA, DU172, DU422, and ZM197) for clades B and C not included in Tables 17A and 17B.

PG9, PG16, and PGC14 were next evaluated on a large multi-clade pseudovirus panel consisting of 162 viruses to further assess the neutralization breadth and potency of these three antibodies (Tables 5A-5B, Tables 18A-18F and Tables 19A-19B). The bNAbs b12, 2G12, 2F5, and 4E10, as well as the donor's serum, were also included in the panel for comparison. Overall, PG9 neutralized 127 out of 162 and PG16 neutralized 119 out of 162 viruses with a potency that frequently considerably exceeded that noted for the four control bNAbs.

The median IC50 and IC90 values for neutralized viruses across all clades were an order of magnitude lower for PG9 and PG16 than any of the four existing bNAbs (Table 5A, Tables 18A-18F and Tables 19A-19B). Both mAbs showed overall greater neutralization breadth than b12, 2G12, and 2F5 (Table 5B, Tables 18A-18F and Tables 19A-19B). At low antibody concentrations, PG9 and PG16 also demonstrated greater neutralization breadth than 4E10 (Table 5B). Furthermore, both mAbs potently neutralized one virus (IAVI-C18) that exhibits resistance to all four existing bNAbs (Tables 18A-18F). The mAb neutralization curves reveal that, whereas the PG9 neutralization curves usually exhibit sharp slopes, the neutralization curves for PG16 sometimes exhibit gradual slopes or plateaus at less than 100% neutralization. Although neutralization curves with similar profiles have been reported previously (W. J. Honnen et al., J Virol 81, 1424 (February, 2007), A. Pinter et al., J Virol 79, 6909 (June, 2005)), the mechanism for this is not well understood.

Comparison of the neutralization profile of the serum with the neutralization profile of PG9, PG16 and PGC14 revealed that these three antibodies could recapitulate the breadth of the serum neutralization in most cases (Tables 18A-18F). For example, almost all of the viruses that were neutralized by the serum with an IC50>1:500 were neutralized by PG9 and/or PG16 at <0.05 μg/mL. The one case where this did not occur was against HIV-1SF162, but this virus was potently neutralized by PGC14. Despite the fact that PG9 and PG16 are somatic variants, they exhibited different degrees of potency against a number of the viruses tested. For instance, PG9 neutralized HIV-16535.30 approximately 185 times more potently than PG16, and PG16 neutralized HIV-1MGRM-AG-001 approximately 440 times more potently than PG9. In some cases, the two antibodies also differed in neutralization breadth; PG9 neutralized nine viruses that were not affected by PG16, and PG16 neutralized two viruses that were not affected by PG9. Based on these results, it is postulated that broad serum neutralization might be mediated by somatic antibody variants that recognize slightly different epitopes and display varying degrees of neutralization breadth and potency against any given virus. In the face of an evolving viral response, it seems reasonable that the immune system might select for these types of antibodies.

Comparison of the neutralization profile of the serum with the neutralization profile of PG9, PG16 and PGC14 revealed that these three antibodies could recapitulate the breadth of the serum neutralization in most cases. For example, almost all of the viruses that were neutralized by the serum with an IC50>1:1000 were neutralized by PG9 and/or PG16 at <0.005 μg/mL. The one case where this did not occur was against HIV-1SF162, but this virus was potently neutralized by PGC14. Tables 5(a) and 5(b) show the neutralization activities—breadth and potency, respectively—of PG9, PG16, and PGC14 as well as four control bNAbs as measured by IC50 values. Tables 19A-19B show results of the same analysis using IC$_{90}$ values.

TABLE 5(A)

Neutralization Potency of mAbs

| Clade[a] | # viruses | Median IC$_{50}$ (μg/mL) against viruses neutralized with an IC$_{50}$ <50 μg/mL | | | | | | |
|---|---|---|---|---|---|---|---|---|
| | | b12 | 2G12 | 2F5 | 4E10 | PG9 | PG16 | PGC14 |
| A | 27 | 6.98 | 17.10 | 5.70 | 6.20 | 0.16 | 0.11 | 41.59 |
| B | 31 | 0.80 | 0.82 | 2.41 | 5.22 | 0.43 | 0.70 | 21.88 |
| C | 27 | 6.46 | 2.93 | 31.51 | 2.97 | 0.22 | 0.25 | 11.97 |
| D | 25 | 1.47 | 7.71 | 3.17 | 4.60 | 0.10 | 0.02 | 38.57 |
| CRF01_AE | 10 | 21.53 | >50 | 0.26 | 0.51 | 0.08 | 0.03 | >50 |
| CRF_AG | 10 | 10.40 | 0.95 | 0.64 | 1.42 | 0.80 | 0.03 | 45.10 |
| G | 15 | 3.07 | 31.03 | 1.24 | 1.44 | 0.29 | 1.21 | >50 |
| F | 15 | >50 | 9.23 | 1.78 | 2.30 | 0.09 | 0.08 | 25.71 |
| Total | 162 | 2.82 | 2.43 | 2.30 | 3.24 | 0.22 | 0.15 | 25.99 |

[a]CRF_07BC and CRF_08BC viruses are not included in the clade analysis because there was only one virus tested from each of these clades.

TABLE 5(B)

Neutralization Breadth of mAbs

| Clade[a] | # viruses | b12 | 2G12 | 2F5 | 4E10 | PG9 | PG16 | PGC14 |
|---|---|---|---|---|---|---|---|---|
| | | % viruses neutralized with an IC$_{50}$ <50 μg/mL | | | | | | |
| A | 27 | 30 | 37 | 74 | 96 | 85 | 85 | 11 |
| B | 31 | 58 | 71 | 68 | 97 | 74 | 74 | 29 |
| C | 27 | 33 | 11 | 7 | 96 | 78 | 78 | 19 |
| D | 25 | 48 | 24 | 56 | 96 | 76 | 60 | 8 |
| CRF01_AE | 10 | 30 | 0 | 89 | 100 | 100 | 100 | 0 |
| CRF_AG | 10 | 30 | 50 | 80 | 100 | 80 | 60 | 10 |
| G | 15 | 13 | 20 | 80 | 100 | 87 | 73 | 7 |
| F | 15 | 0 | 21 | 87 | 100 | 67 | 64 | 13 |
| Total | 162 | 35 | 32 | 60 | 98 | 79 | 73 | 15 |
| | | % viruses neutralized with an IC$_{50}$ <1.0 μg/mL | | | | | | |
| A | 27 | 0 | 4 | 4 | 0 | 70 | 63 | 0 |
| B | 31 | 32 | 39 | 23 | 0 | 45 | 42 | 3 |
| C | 27 | 7 | 0 | 0 | 11 | 56 | 48 | 0 |
| D | 25 | 12 | 8 | 12 | 8 | 48 | 44 | 0 |
| CRF01_AE | 10 | 11 | 0 | 88 | 80 | 70 | 70 | 0 |
| CRF_AG | 10 | 10 | 30 | 60 | 30 | 40 | 50 | 0 |
| G | 15 | 0 | 0 | 27 | 0 | 60 | 33 | 0 |
| F | 15 | 0 | 14 | 13 | 28 | 80 | 79 | 0 |
| Total | 162 | 11 | 12 | 19 | 12 | 57 | 51 | 1 |

[a]CRF_07BC and CRF_08BC viruses are not included in the clade analysis because there was only one virus tested from each of these clades.

Despite the fact that PG9 and PG16 are somatic variants, they exhibited different degrees of potency against a number of the viruses tested. For instance, PG9 neutralized the virus 6535.30 about 100 times more potently than PG16, and PG16 neutralized the virus MGRM-AG-001 about 3000 times more potently than PG9. In some cases, the two antibodies also differed in neutralization breadth; PG9 neutralized seven viruses that were not neutralized by PG16, and PG16 neutralized three viruses that were not neutralized by PG9. Without being bound by theory, it appears that broad serum neutralization might be mediated by somatic variants that recognize slightly different epitopes and display varying degrees of neutralization breadth and potency against any given virus. In the face of an evolving viral response, the immune system likely selects for these types of antibodies.

Figure 5:
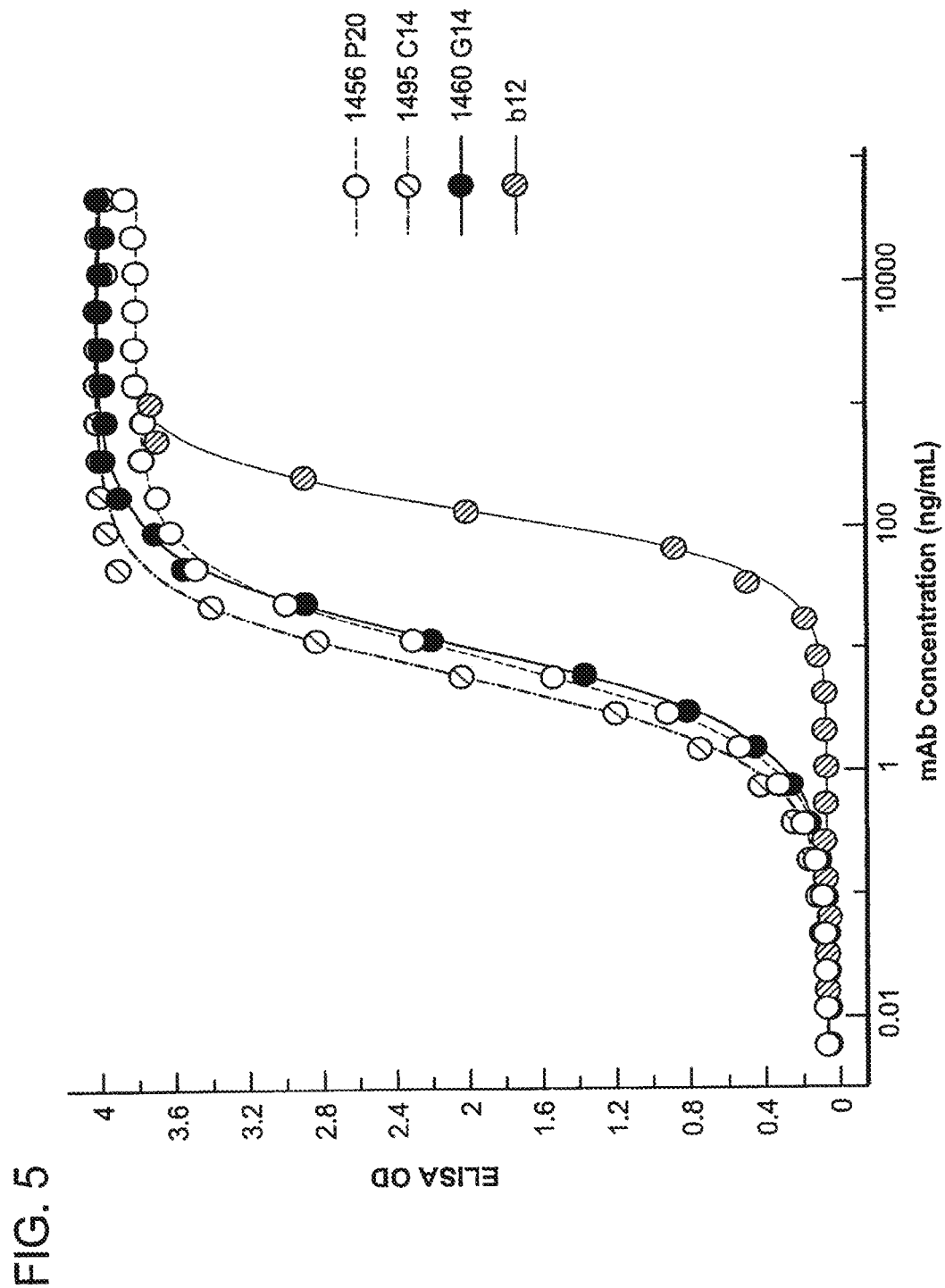
FIG. 5 is a graph depicting the dose response curves of 1456_P20 (PG20), 1495_C14 (PGC14) and 1460_G14 (PGG14) binding to recombinant gp120 in ELISA as compared to control anti-gp120 (b12). Data is presented as average OD values of triplicate ELISA wells obtained on the same plate.
Figure 6:
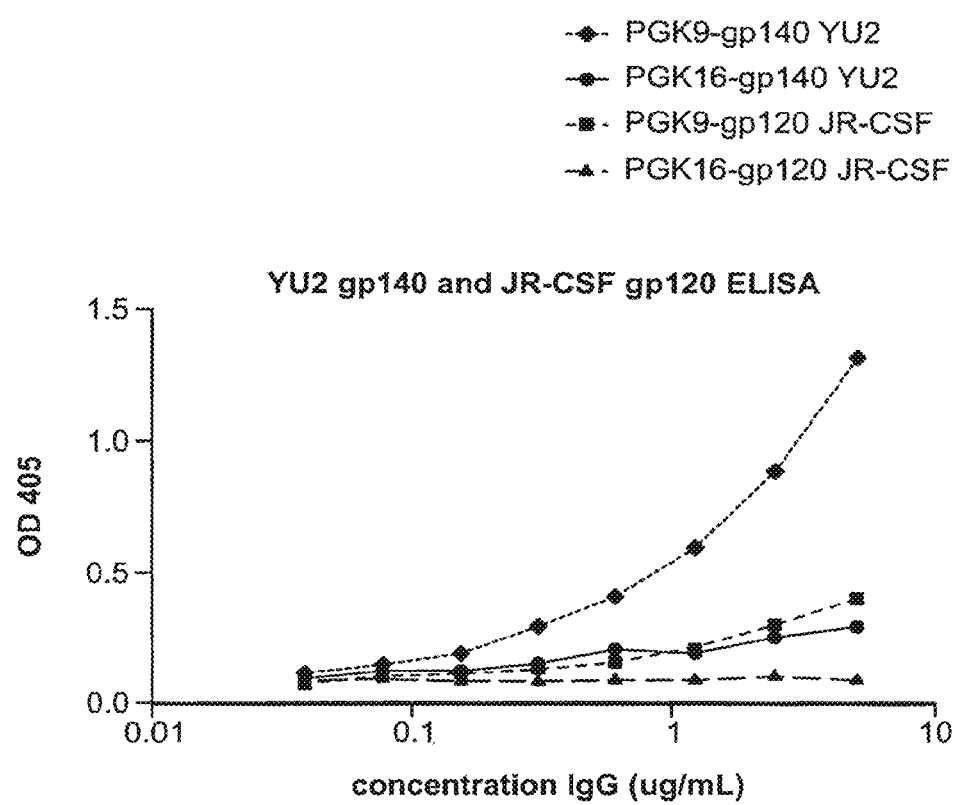
FIG. 6 is a series of graphs depicting the results from ELISA binding assays of monoclonal antibodies 1443_C16
Figure 6:
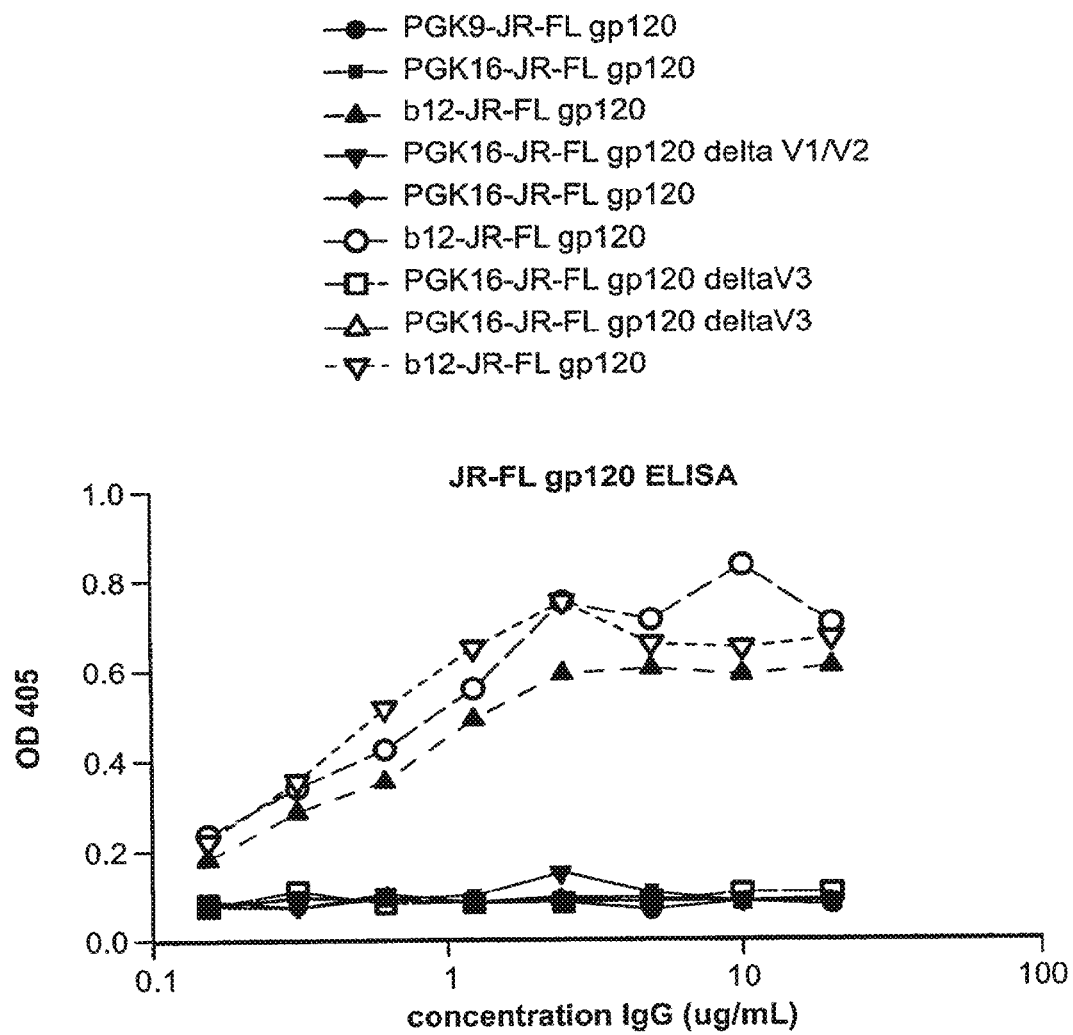

The antibodies were also tested for ability to bind soluble recombinant HIV envelope proteins. FIG. 5 shows dose response curves of 1456_P20 (PG20), 1495_C14 (PGC14) and 1460_G14 (PGG14) binding to recombinant gp120 in ELISA as compared to control anti-gp120 (b12). FIG. 6 shows ELISA binding assays of monoclonal antibodies 1443_C16 (PG16) and 1496_C09 (PG9) to HIV-1 strain YU2 gp140 and JR-CSF gp120, the membrane proximal region (MPER) of HIV-1 envelope glycoprotein gp41, and the V3 polypeptide. PG-9 binds to YU2 gp140 ($IC_{50}$~20-40 nM), YU2 gp120 and weakly binds to JR-CSF gp120. However, PG16 weakly binds Yu2 gp120, but not the soluble form of HIV-1 envelope glycoprotein, gp120 JR-CSF. Neither mAb binds to JR-FL gp120, JR-FL gp140, MPER peptide of gp41 or V3 peptide.

FIG. 7 shows binding of monoclonal antibodies 1443_C16 (PG16) and 1496_C09 (PG9) to HIV-1 YU2 gp160 expressed on the cell surface in the presence and absence of sCD4. Competitive inhibition of the binding by sCD4 indicates that the binding of monoclonal antibody 1496_C09 to HIV-1 envelope protein gp160 expressed on the cell surface is presumably affected due to the conformational changes induced by sCD4. The data further suggest that 1443_06 (PG16) and 1496_C09 (PG9) exhibit relatively stronger binding to trimeric forms of the HIV-1 Env (gp160 and gp140) than to the monomeric gp120.

FIG. 8 shows binding of monoclonal antibodies 1443_C16 (PG16) and 1496_C09 (PG9) to HIV-1 transfected cells. PG9 and PG16 do not bind untransfected cells. PG9 and PG16 bind JR-CSF, ADA, and YU2 gp160 transfected cells. PG9 and PG16 do not bind JR-FL gp160 transfected cells (cleaved or uncleaved). PG9 and PG16 do not bind ADA ΔV1/ΔV2 transfected cells. PG9 and PG16 binding to JR-CSF gp160 transfected cells is inhibited by sCD4.

FIG. 9 shows the capturing of entry-competent JR-CSF pseudovirus by neutralizing monoclonal antibodies 1443_C16 (PG16) and 1496_C09 (PG9) in a dose-dependent manner. The ability of both antibodies to capture JR-CSF pseudovirus is higher than IgG b12 but comparable to IgG 2G12. It is postulated that the capture may be mediated by the binding of the mAbs to the HIV-1 Env on the virions.

FIG. 10A shows that sCD4, PG16 and PG9 compete for the binding of monoclonal antibody 1443_C16 (PG16) to JR-CSF pseudovirus but b12, 2G12, 2F5 and 4E10 do not. FIG. 10B shows sCD4, PG16 and PG9 compete for the binding of monoclonal antibody 1496_C09 (PG9) to JR-CSF pseudovirus but b12, 2G12, 2F5 and 4E10 do not. This suggests that the PG16 and PG9 mAbs bind gp120 at a site different from those bound by b12 and 2G12. PG9 and PG16 binding to HIV-1 envelope protein is competitively inhibited by sCD4. Given that the MAbs are not inhibited by the CD4 binding site MAb b12, this suggests that PG9 and PG16 are binding to an epitope that is unavailable for sCD4 binding to gp120 as a result of conformational changes. The inability of PG9 and PG16 to bind monomeric gp120JR-CSF or gp41HxB2 in the initial screen while potently neutralizing HIV-1JR-CSF suggests that the epitope targeted by these antibodies is preferentially expressed on trimeric HIV envelope protein. The ability of PG9 and PG16 to bind monomeric gp120 from several different strains, artificially trimerized gp140 constructs, and trimeric Env expressed on the surface of transfected cells respectively, was compared. Although both antibodies bound with high affinity to cell surface Env, PG16 did not bind to any of the soluble gp120 or gp140 constructs and PG9 bound only weakly to monomeric gp120 and trimerized gp140 from certain strains (FIG. 11). It has been previously shown that a substantial fraction of cell surface Env is comprised of uncleaved gp160 molecules. (Pancera, M. & Wyatt, R. Virology 332, 145-156 (2005)). That PG9 and PG16 do not exhibit exclusive specificity for native HIV-1 trimers was confirmed by the fact that both antibodies bound with high affinity to cleavage-defective HIV-1YU2 trimers expressed on the surface of transfected cells (FIG. 12).

Figure 13A:
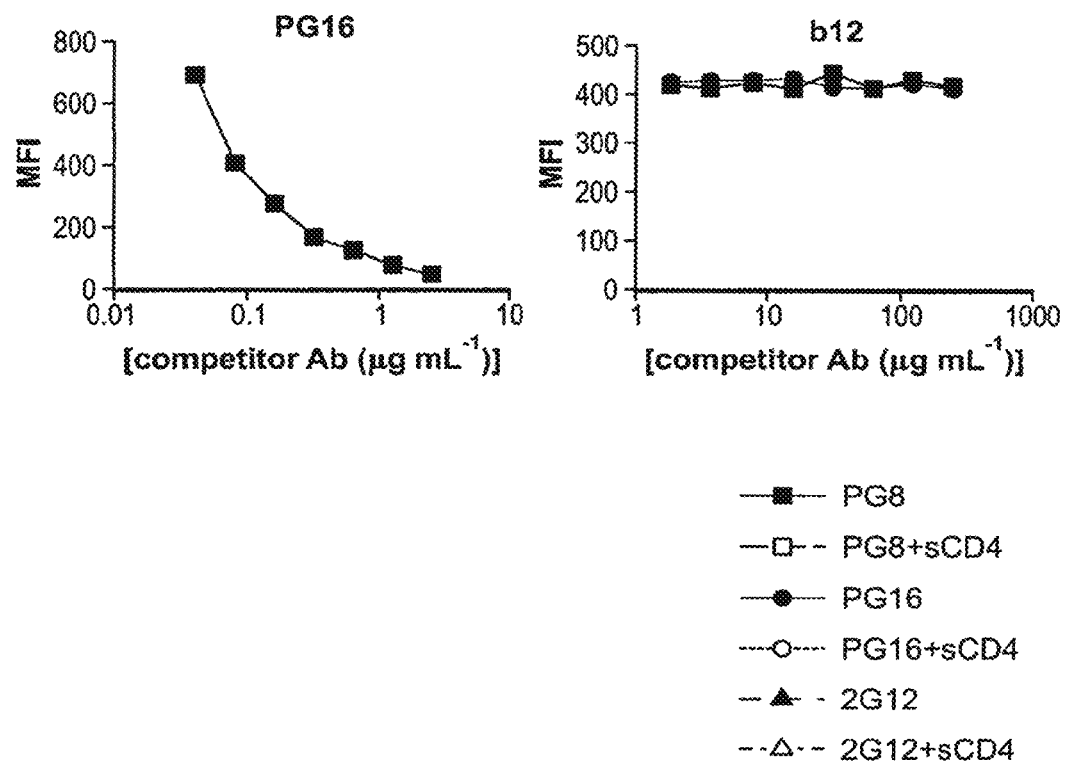
Figure 13B:
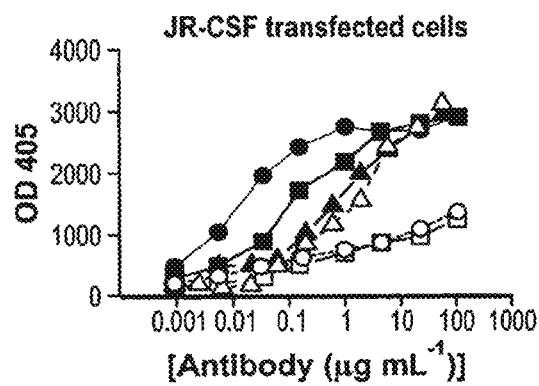
Figure 13C:
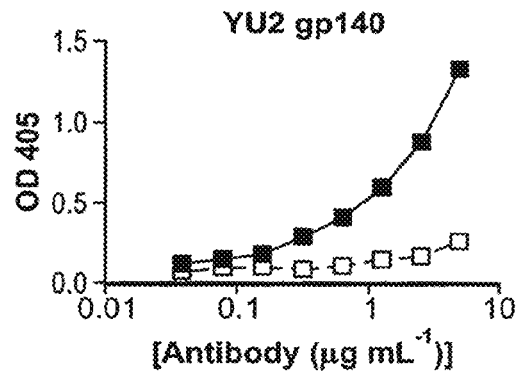

The epitopes recognized by PG9 and PG16 were investigated. Since the PG9 and PG16 antibodies are somatic variants, they recognize the same or overlapping epitopes. Both antibodies cross-competed for binding to HIV-1JR-CSF transfected cells (FIG. 13A). Ligation of monomeric gp120 or cell surface Env with soluble CD4 diminished binding of both PG9 and PG16, although neither antibody competed with CD4-binding site antibodies for trimer binding (FIG. 13A-13C). This result suggests that CD4-induced conformational changes cause a loss of the epitope targeted by the antibodies.

Figure 13D:
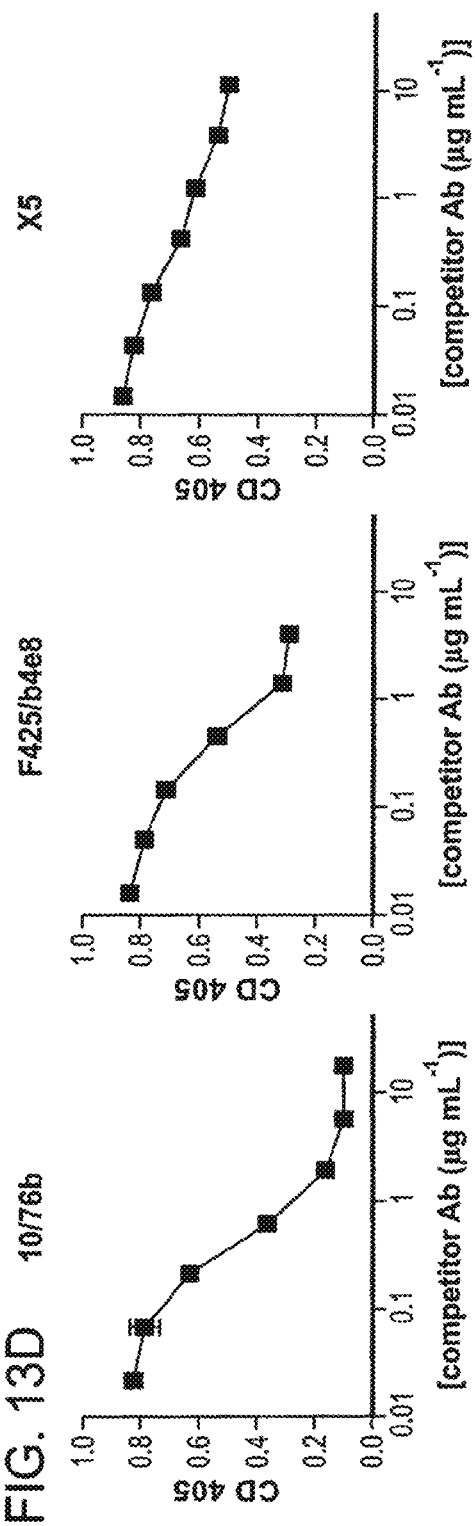

Since PG9 bound well enough to gp120 from certain isolates to generate ELISA binding curves, competition ELISAs were performed with PG9 using a panel of neutralizing and non-neutralizing antibodies. These data revealed that PG9 cross-competed with anti-V2, anti-V3, and to a lesser extent, CD4i antibodies for gp120. (FIGS. 13D and 14).

Figure 13E:
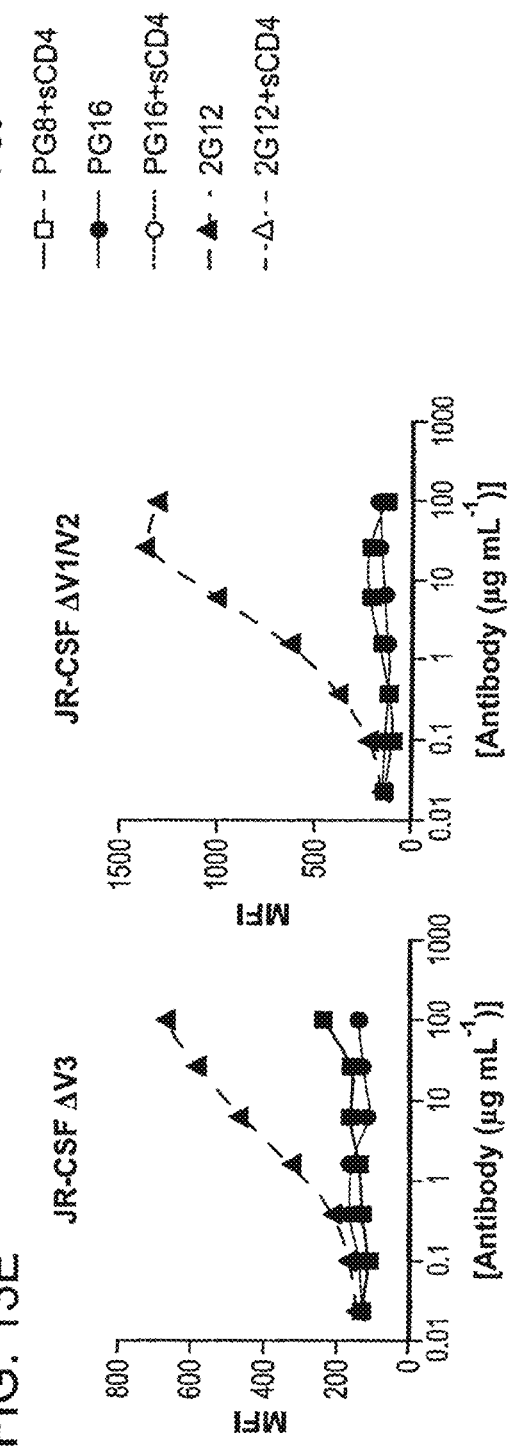

Neither PG9 nor PG16 bound to V1/V2 or V3 deleted HIV-1JR-CSF variants expressed on the surface of transfected cells, further suggesting contributions of variable loops in forming their epitopes (FIG. 13E).

To dissect the fine specificity of PG9 and PG16, alanine scanning was performed using a large panel of HIV-1JR-CSF Env alanine mutants that have been described previously (Pantophlet, R., et al. J Virol 77, 642-658 (2003); Pantophlet, R., et al. J Virol 83, 1649-1659 (2009); Darbha, R., et al. Biochemistry 43, 1410-1417 (2004); Scanlan, C. N., et al. J Virol 76, 7306-7321 (2002)) as well as several new alanine mutants. Pseudoviruses incorporating single Env alanine mutations were generated, and PG9 and PG16 were tested for neutralization activity against each mutant pseudovirus. Mutations that resulted in viral escape from PG9 and PG16 neutralization were considered important for formation of the PG9 and PG16 epitopes (Tables 12 and 13).

Based on these criteria, and consistent with the competition experiments, residues that form the epitopes recognized by PG9 and PG16 appear to be located in conserved regions of the V2 and V3 loops of gp120. Certain co-receptor binding site mutations also had an effect on PG9 and PG16 neutralization, albeit to a lesser extent. Generally, PG9 and PG16 were dependent on the same residues, although PG16 was more sensitive to mutations located in the tip of the V3 loop than PG9. Interestingly, although neither antibody bound to wild-type HIV-1JR-FL transfected cells, a D to K mutation at position 168 in the V2 loop of HIV-1JR-FL generated high-affinity PG9 and PG16 recognition (Tables 18A-18F). N156 and N160, sites of V2 N-glycosylation, also appear to be critical in forming the epitope since substitutions at these positions resulted in escape from PG9 and PG16 neutralization. Deglycosylation of gp120 abolished binding of PG9 (FIG. 16), confirming that certain glycans may be important in forming the epitope.

HIV-1 SF162 contains a rare N to K polymorphism at position 160, and mutation of this residue to an Asn renders this isolate sensitive to PG9 and PG16 (FIG. 17).

The preferential binding of PG9 and PG16 to native trimers could either be a consequence of gp120 subunit cross-linking or recognition of a preferred oligomeric gp120 conformation. To address this question, the binding profiles of PG9 and PG16 to mixed HIV-1YU2 trimers were examined, in which two gp120 subunits containing point mutations abolished binding of the two antibodies. A third substitution that abrogates binding of 2G12, which binds with high affinity to both monomeric gp120 and trimeric Env, was also introduced into the same construct as an internal control. Cell surface binding analysis revealed that all three antibodies bound to the mixed trimers with similar apparent affinity as to wild-type trimers and all saturated at a similar lower level (FIG. 18). This result suggests that the preference of PG9 and PG16 for trimeric Env is due to gp120 subunit presentation in the context of the trimeric spike rather than gp120 cross-linking.

It has been shown that NAbs that bind to epitopes encompassing parts of the V2 or both the V2 and V3 domains can exhibit potency comparable to that of PG9 and PG16, although these antibodies have thus far displayed strong strain-specificity. (Honnen, W. J., et al. *J Virol* 81, 1424-1432 (2007); Gorny, M. K., et al., *J Virol* 79, 5232-5237 (2005)). Importantly, the epitopes recognized by these antibodies have been shown to differ from that of the clade B consensus sequence only by single amino acid substitutions, which suggested the existence of a relatively conserved structure within the V2 domain. (Honnen, W. J., et al. *J Virol* 81, 1424-1432 (2007)). The results observed with PG9 and PG16 confirm that this region serves as a potent neutralization target and demonstrates that antibodies that recognize conserved parts of V2 and V3 can possess broad reactivity.

The invention is based on novel monoclonal antibodies and antibody fragments that broadly and potently neutralize HIV infection. In some embodiments, these monoclonal antibodies and antibody fragments have a particularly high potency in neutralizing HIV infection in vitro across multiple clades or across a large number of different HIV species. Such antibodies are desirable, as only low concentrations are required to neutralize a given amount of virus. This facilitates higher levels of protection while administering lower amounts of antibody. Human monoclonal antibodies and the immortalized B cell clones that secrete such antibodies are included within the scope of the invention.

The invention provides methods for using high throughput functional screening to select neutralizing antibodies with unprecedented breadth and potency. The invention relates to other potent and broadly neutralizing antibodies that can be developed using the same methods. In particular, the invention relates to potent, broadly neutralizing antibodies against different strains of HIV, wherein the bNAbs bind poorly to recombinant forms of Env. The invention provides two neutralizing antibodies, PG9 and PG16, with broad neutralizing activities particularly against non-clade B isolates. The invention provides vaccine-induced antibodies of high specificity that provide protection against a diverse range of the most prevalent isolates of HIV circulating worldwide. The invention provides antibodies with very high and broad neutralization potency, such as that exhibited by PG9 and PG16 in vitro, which provides protection at relatively modest serum concentrations, and are generated by vaccination unlike the broad NAbs known in the art. The invention provides immunogens that can be designed that focus the immune response on conserved regions of variable loops in the context of the trimeric spike of the gp120 subunit of the Env protein.

The invention also relates to the characterization of the epitope to which the antibodies bind and the use of that epitope in raising an immune response.

The invention also relates to various methods and uses involving the antibodies of the invention and the epitopes to which they bind. For example, monoclonal antibodies according to the invention can be used as therapeutics. In some aspects, the monoclonal antibodies are used for adjuvant therapy. Adjuvant therapy refers to treatment with the therapeutic monoclonal antibodies, wherein the adjuvant therapy is administered after the primary treatment to increase the chances of a cure or reduce the statistical risk of relapse.

The invention provides novel monoclonal or recombinant antibodies having particularly high potency in neutralizing HIV. The invention also provides fragments of these recombinant or monoclonal antibodies, particularly fragments that retain the antigen-binding activity of the antibodies, for example which retain at least one complementarity determining region (CDR) specific for HIV proteins. In this specification, by "high potency in neutralizing HIV" is meant that an antibody molecule of the invention neutralizes HIV in a standard assay at a concentration lower than antibodies known in the art.

Preferably, the antibody molecule of the present invention can neutralize at a concentration of 0.16 μg/ml or lower (i.e. 0.15, 0.125, 0.1, 0.075, 0.05, 0.025, 0.02, 0.016, 0.015, 0.0125, 0.01, 0.0075, 0.005, 0.004 or lower), preferably 0.016 μg/ml or lower (an antibody concentration of $10^{-8}$ or lower, preferably $10^{-9}$ M or lower, preferably $10^{-10}$ M or lower, i.e. $10^{-11}$ M, $10^{-12}$ M, $10^{-13}$ M or lower). This means that only very low concentrations of antibody are required for 50% neutralization of a clinical isolate of HIV in vitro. Potency can be measured using a standard neutralization assay as described in the art.

The antibodies of the invention are able to neutralize HIV. Monoclonal antibodies can be produced by known procedures, e.g., as described by R. Kennet et al. in "Monoclonal Antibodies and Functional Cell Lines; Progress and Applications". Plenum Press (New York), 1984. Further materials and methods applied are based on known procedures, e.g., such as described in J. Virol. 67:6642-6647, 1993.

These antibodies can be used as prophylactic or therapeutic agents upon appropriate formulation, or as a diagnostic tool.

A "neutralizing antibody" is one that can neutralize the ability of that pathogen to initiate and/or perpetuate an infection in a host and/or in target cells in vitro. The invention provides a neutralizing monoclonal human antibody, wherein the antibody recognizes an antigen from HIV.

Preferably an antibody according to the invention is a novel monoclonal antibody referred to herein as 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23

(PGT-157), and 6881_N05 (PGT-158). These antibodies were initially isolated from human samples and are produced by the B cell cultures referred to as 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158). These antibodies have been shown to neutralize HIV in vitro. 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114__A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and 6881_N05 (PGT-158) have been shown to have broad, potent HIV neutralizing activity.

The CDRs of the antibody heavy chains are referred to as CDRH1, CDRH2 and CDRH3, respectively. Similarly, the CDRs of the antibody light chains are referred to as CDRL1, CDRL2 and CDRL3, respectively. The position of the CDR amino acids is defined according to the IMGT numbering system as: CDR1-IMGT positions 27 to 38, CDR2-IMGT positions 56 to 65 and CDR3-IMGT positions 105 to 117. (Lefranc, M P. et al. 2003 IMGT unique numbering for immunoglobulin and T cell receptor variable regions and Ig superfamily V-like domains. Dev Comp Immunol. 27(1): 55-77; Lefranc, M P. 1997. Unique database numbering system for immunogenetic analysis. Immunology Today, 18:509; Lefranc, M P. 1999. The IMGT unique numbering for Immunoglobulins, T cell receptors and Ig-like domains. The Immunologist, 7:132-136.)

The amino acid sequences of the CDR3 regions of the light and heavy chains of the antibodies are shown in Tables 3A and 3B.

A phylogram is a branching diagram (tree) assumed to be an estimate of phylogeny, branch lengths are proportional to the amount of inferred evolutionary change. Tree diagrams of the five heavy chains and the five light chains were prepared using ClustalW (Larkin M. A., Blackshields G., Brown N. P., Chenna R., McGettigan P. A., McWilliam H., Valentin F., Wallace I. M., Wilm A., Lopez R., Thompson J. D., Gibson T. J. and Higgins D. G. *Bioinformatics* 23(21): 2947-2948 (2007); Higgins D G et al. Nucleic Acids Research 22: 4673-4680. (1994)) and are shown in FIGS. 1A and 1B respectively.

The sequences of the antibodies were determined, including the sequences of the variable regions of the Gamma heavy and Kappa or Lambda light chains of the antibodies designated 1496_C09 (PG9), 1443_C16 (PG16), 1456_P20 (PG20), 1460_G14 (PGG14), and 1495_C14 (PGC14). In addition, the sequence of each of the polynucleotides encoding the antibody sequences was determined. Shown below are the polypeptide and polynucleotide sequences of the gamma heavy chains and kappa light chains, with the signal peptides at the N-terminus (or 5' end) and the constant regions at the C-terminus (or 3' end) of the variable regions, which are shown in bolded text.

1443_C16 (PG16) (TCN-116) gamma heavy chain nucleotide sequence: 1443_C16 γ3 coding sequence (variable region in bold)

```
(SEQ ID NO: 11)
ATGGAGTTTGGGCTGAGCTGGGTTTTCCTCGCAACTCTGTTAAGAGTTG

TGAAGTGTCAGGAACAACTGGTGGAGTCTGGGGGAGGCGTGGTCC

AGCCGGGGGGGTCCCTGAGACTCTCCTGTTTAGCGTCTGGATTCA

CGTTTCACAAATATGGCATGCACTGGGTCCGCCAGGCTCCAGGCA

AGGGCCTGGAGTGGGTGGCACTCATCTCAGATGACGGAATGAGGA

AATATCATTCAGACTCCATGTGGGGCCGAGTCACCATCTCCAGAG

ACAATTCCAAGAACACTCTTTATCTGCAATTCAGCAGCCTGAAAGT

CGAAGACACGGCTATGTTCTTCTGTGCGAGAGAGGCTGGTGGGCC

AATCTGGCATGACGACGTCAAATATTACGATTTTAATGACGGCTAC

TACAACTACCACTACATGGACGTCTGGGGCAAGGGGACCACGGTC

ACCGTCTCGAGCGCCTCCACCAAGGGCCCATCGGTCTTCCCCCTGGC

ACCCTCCTCCAAGAGCACCTCTGGGGGCACAGCGGCCCTGGGCTGCCT

GGTCAAGGACTACTTCCCCGAACCGGTGACGGTGTCGTGGAACTCAGG

CGCCCTGACCAGCGGCGTGCACACCTTCCCGGCTGTCCTACAGTCCTC

AGGACTCTACTCCCTCAGCAGCGTGGTGACCGTGCCCTCCAGCAGCTT

GGGCACCCAGACCTACATCTGCAACGTGAATCACAAGCCCAGCAACA

CCAAGGTGGACAAGAGAGTTGAGCCCAAATCTTGTGACAAAACTCAC

ACATGCCCACCGTGCCCAGCACCTGAACTCCTGGGGGGACCGTCAGTC

TTCCTCTTCCCCCCAAAACCCAAGGACACCCTCATGATCTCCCGGACCC

CTGAGGTCACATGCGTGGTGGTGGACGTGAGCCACGAAGACCCTGAG

GTCAAGTTCAACTGGTACGTGGACGGCGTGGAGGTGCATAATGCCAAG

ACAAAGCCGCGGGAGGAGCAGTACAACAGCACGTACCGTGTGGTCAG

CGTCCTCACCGTCCTGCACCAGGACTGGCTGAATGGCAAGGAGTACAA

GTGCAAGGTCTCCAACAAAGCCCTCCCAGCCCCCATCGAGAAAACCAT

CTCCAAAGCCAAAGGGCAGCCCCGAGAACCACAGGTGTACACCCTGC

CCCCATCCCGGGAGGAGATGACCAAGAACCAGGTCAGCCTGACCTGC

CTGGTCAAAGGCTTCTATCCCAGCGACATCGCCGTGGAGTGGGAGAGC
```

```
AATGGGCAGCCGGAGAACAACTACAAGACCACGCCTCCCGTGCTGGA

CTCCGACGGCTCCTTCTTCCTCTATAGCAAGCTCACCGTGGACAAGAG

CAGGTGGCAGCAGGGGAACGTCTTCTCATGCTCCGTGATGCATGAGGC

TCTGCACAACCACTACACGCAGAAGAGCCTCTCCCTGTCTCCGGGTAA

ATGA
```

1443_C16 (PG16) (TCN-116) gamma heavy chain variable region nucleotide sequence:

```
                                         (SEQ ID NO: 99)
CAGGAACAACTGGTGGAGTCTGGGGGAGGCGTGGTCCAGCCGGGGGG

GTCCCTGAGACTCTCCTGTTTAGCGTCTGGATTCACGTTTCACAAATAT

GGCATGCACTGGGTCCGCCAGGCTCCAGGCAAGGGCCTGGAGTGGGT

GGCACTCATCTCAGATGACGGAATGAGGAAATATCATTCAGACTCCAT

GTGGGGCCGAGTCACCATCTCCAGAGACAATTCCAAGAACACTCTTTA

TCTGCAATTCAGCAGCCTGAAAGTCGAAGACACGGCTATGTTCTTCTG

TGCGAGAGAGGCTGGTGGGCCAATCTGGCATGACGACGTCAAATATTA

CGATTTTAATGACGGCTACTACAACTACCACTACATGGACGTCTGGGG

CAAGGGGACCACGGTCACCGTCTCGAGC
```

1443_C16 (PG16) (TCN-116) gamma heavy chain amino acid sequence: expressed protein with variable region in bold.

```
                                         (SEQ ID NO: 12)
QEQLVESGGGVVQPGGSLRLSCLASGFTFHKYGMHWVRQAPGKGLE

WVALISDDGMRKYHSDSMWGRVTISRDNSKNTLYLQFSSLKVEDTA

MFFCAREAGGPIWHDDVKYYDFNDGYYNYHYMDVWGKGTTVTVSS

ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK
```

1443_C16 (PG16) (TCN-116) gamma heavy chain variable region amino acid sequence: (Kabat CDRs underlined, Chothia CDRs in bold italics)

```
                                         (SEQ ID NO: 31)
QEQLVESGGGVVQPGGSLRLSCLAS***GFTFHK***YGMHWVRQAPGKGLEW

VA***LISDDGMRKY***HSDSMWGRVTISRDNSKNTLYLQFSSLKVEDTAMF

FCAR***EAGGPIWHDDVKYYDFNDGYYNYHYMDV***WGKGTTVTVSS
```

1443_C16 (PG16) (TCN-116) gamma heavy chain Kabat CDRs:

```
                                         (SEQ ID NO: 88)
    CDR 1: KYGMH (SEQ ID NO: 89)
    CDR 2: LISDDGMRKYHSDSMWG (SEQ ID NO: 6)
    CDR 3: EAGGPIWHDDVKYYDFNDGYYNYHYMDV
```

1443_C16 (PG16) (TCN-116) gamma heavy chain Chothia CDRs:

```
                                         (SEQ ID NO: 266)
    CDR 1: GFTFHK (SEQ ID NO: 267)
    CDR 2: LISDDGMRKY (SEQ ID NO: 6)
    CDR 3: EAGGPIWHDDVKYYDFNDGYYNYHYMDV
```

1443_C16 (PG16) (TCN-116) lambda light chain nucleotide sequence: 1443_C16 λ2 coding sequence (variable region in bold)

```
                                         (SEQ ID NO: 13)
ATGGCCTGGGCTCTGCTATTCCTCACCCTCTTCACTCAGGGCACAGGGT

CCTGGGGCCAGTCTGCCCTGACTCAGCCTGCCTCCGTGTCTGGGTC

TCCTGGACAGACGATCACCATCTCCTGCAATGGAACCAGCAGTGA

CGTTGGTGGATTTGACTCTGTCTCCTGGTACCAACAATCCCCAGG

GAAAGCCCCCAAAGTCATGGTTTTTGATGTCAGTCATCGGCCCTC

AGGTATCTCTAATCGCTTCTCTGGCTCCAAGTCCGGCAACACGGC

CTCCCTGACCATCTCTGGGCTCCACATTGAGGACGAGGGCGATTA

TTTCTGCTCTTCACTGACAGACAGAAGCCATCGCATATTCGGCGG

CGGGACCAAGGTGACCGTTCTAGGTCAGCCCAAGGCTGCCCCCTCG

GTCACTCTGTTCCCGCCCTCCTCTGAGGAGCTTCAAGCCAACAAGGCC

ACACTGGTGTGTCTCATAAGTGACTTCTACCCGGGAGCCGTGACAGTG

GCCTGGAAGGCAGATAGCAGCCCCGTCAAGGCGGGAGTGGAGACCAC

CACACCCTCCAAACAAAGCAACAACAAGTACGCGGCCAGCAGCTACC

TGAGCCTGACGCC

TGAGCAGTGGAAGTCCCACAAAAGCTACAGCTGCCAGGTCACGCATG

AAGGGAGCACCGTGGAGAAGACAGTGGCCCCTACAGAATGTTCATAG
```

1443_C16 (PG16) (TCN-116) lambda light chain variable region nucleotide sequence:

```
                                         (SEQ ID NO: 100)
CAGTCTGCCCTGACTCAGCCTGCCTCCGTGTCTGGGTCTCCTGGACAGA

CGATCACCATCTCCTGCAATGGAACCAGCAGTGACGTTGGTGGATTTG

ACTCTGTCTCCTGGTACCAACAATCCCCAGGGAAAGCCCCCAAAGTCA

TGGTTTTTGATGTCAGTCATCGGCCCTCAGGTATCTCTAATCGCTTCTC

TGGCTCCAAGTCCGGCAACACGGCCTCCCTGACCATCTCTGGGCTCCA
```

1443_C16 (PG16) (TCN-116) lambda light chain amino acid sequence: expressed protein with variable region in bold.

(SEQ ID NO: 14)
QSALTQPASVSGSPGQTITISCNGTSSDVGGFDSVSWYQQSPGKAPKV

MVFDVSHRPSGISNRFSGSKSGNTASLTISGLHIEDEGDYFCSSLTDRS

HRIFGGGTKVTVLGQPKAAPSVTLFPPSSEELQANKATLVCLISDFYPGA

VTVAWKADSSPVKAGVETTTPSKQSNNKYAASSYLSLTPEQWKSHKSYS

CQVTHEGSTVEKTVAPTECS

1443_C16 (PG16) (TCN-116) lambda light chain variable region amino acid sequence: (Kabat CDRs underlined, Chothia CDRs in bold italics)

(SEQ ID NO: 32)
QSALTQPASVSGSPGQTITISC*NGTSSDVGGFDSVS*WYQQSPGKAPK

VMVF*DVSHRPS*GISNRFSGSKSGNTASLTISGLHIEDEGDYFC

*SSLTDRSHRI*FGGGTKVTVL

1443_C16 (PG16) (TCN-116) lambda light chain Kabat CDRs:

(SEQ ID NO: 97)
CDR 1: NGTSSDVGGFDSVS (SEQ ID NO: 95)
CDR 2: DVSHRPS (SEQ ID NO: 41)
CDR 3: SSLTDRSHRI

1443_C16 (PG16) (TCN-116) lambda light chain Chothia CDRs:

(SEQ ID NO: 97)
CDR 1: NGTSSDVGGFDSVS (SEQ ID NO: 95)
CDR 2: DVSHRPS (SEQ ID NO: 41)
CDR 3: SSLTDRSHRI

1456_P20 (PG20) gamma heavy chain nucleotide sequence: 1456_P20 γ1 coding sequence (variable region in bold)

(SEQ ID NO: 15)
ATGGACTGGATTTGGAGGTTCCTCTTTGTGGTGGCAGCAGCTACAGGT

GTCCAGTCCCAGGTCCGCCTGGTACAGTCTGGGCCTGAGGTGAAG

AAGCCTGGGTCCTCGGTGACGGTCTCCTGCCAGGCTTCTGGAGGC

ACCTTCAGCAGTTATGCTTTCACCTGGGTGCGCCAGGCCCCCGGA

CAAGGTCTTGAGTGGTTGGGCATGGTCACCCCAATCTTTGGTGAG

GCCAAGTACTCACAAAGATTCGAGGGCAGAGTCACCATCACCGCG

GACGAATCCACGAGCACAACCTCCATAGAATTGAGAGGCCTGACA

TCCGAAGACACGGCCATTTATTACTGTGCGCGAGATCGGCGCGCG

GTTCCAATTGCCACGGACAACTGGTTAGACCCCTGGGGCCAGGGG

ACCCTGGTCACCGTCTCGAGCGCCTCCACCAAGGGCCCATCGGTCTT

CCCCCTGGCACCCTCCTCCAAGAGCACCTCTGGGGGCACAGCGGCCCT

GGGCTGCCTGGTCAAGGACTACTTCCCCGAACCGGTGACGGTGTCGTG

GAACTCAGGCGCCCTGACCAGCGGCGTGCACACCTTCCCGGCTGTCCT

ACAGTCCTCAGGACTCTACTCCCTCAGCAGCGTGGTGACCGTGCCCTC

CAGCAGCTTGGGCACCCAGACCTACATCTGCAACGTGAATCACAAGCC

CAGCAACACCAAGGTGGACAAGAGAGTTGAGCCCAAATCTTGTGACA

AAACTCACACATGCCCACCGTGCCCAGCACCTGAACTCCTGGGGGGAC

CGTCAGTCTTCCTCTTCCCCCCAAAACCCAAGGACACCCTCATGATCTC

CCGGACCCCTGAGGTCACATGCGTGGTGGTGGACGTGAGCCACGAAG

ACCCTGAGGTCAAGTTCAACTGGTACGTGGACGGCGTGGAGGTGCATA

ATGCCAAGACAAAGCCGCGGGAGGAGCAGTACAACAGCACGTACCGT

GTGGTCAGCGTCCTCACCGTCCTGCACCAGGACTGGCTGAATGGCAAG

GAGTACAAGTGCAAGGTCTCCAACAAAGCCCTCCCAGCCCCCATCGAG

AAAACCATCTCCAAAGCCAAAGGGCAGCCCCGAGAACCACAGGTGTA

CACCCTGCCCCCATCCCGGGAGGAGATGACCAAGAACCAGGTCAGCCT

GACCTGCCTGGTCAAAGGCTTCTATCCCAGCGACATCGCCGTGGAGTG

GGAGAGCAATGGGCAGCCGGAGAACAACTACAAGACCACGCCTCCCG

TGCTGGACTCCGACGGCTCCTTCTTCCTCTATAGCAAGCTCACCGTGGA

CAAGAGCAGGTGGCAGCAGGGGAACGTCTTCTCATGCTCCGTGATGCA

TGAGGCTCTGCACAACCACTACACGCAGAAGAGCCTCTCCCTGTCTCC

GGGTAAATGA

1456_P20 (PG20) gamma heavy chain variable region nucleotide sequence:

(SEQ ID NO: 101)
CAGGTCCGCCTGGTACAGTCTGGGCCTGAGGTGAAGAAGCCTGGGTCC

TCGGTGACGGTCTCCTGCCAGGCTTCTGGAGGCACCTTCAGCAGTTAT

GCTTTCACCTGGGTGCGCCAGGCCCCCGGACAAGGTCTTGAGTGGTTG

GGCATGGTCACCCCAATCTTTGGTGAGGCCAAGTACTCACAAAGATTC

GAGGGCAGAGTCACCATCACCGCGGACGAATCCACGAGCACAACCTC

CATAGAATTGAGAGGCCTGACATCCGAAGACACGGCCATTTATTACTG

TGCGCGAGATCGGCGCGCGGTTCCAATTGCCACGGACAACTGGTTAGA

CCCCTGGGGCCAGGGGACCCTGGTCACCGTCTCGAGC

1456_P20 (PG20) gamma heavy chain amino acid sequence: expressed protein with variable region in bold.

(SEQ ID NO: 16)
QVRLVQSGPEVKKPGSSVTVSCQASGGTFSSYAFTWVRQAPGQGLE

WLGMVTPIFGEAKYSQRFEGRVTITADESTSTTSIELRGLTSEDTAIYY

CARDRRAVPIATDNWLDPWGQGTLVTVSSASTKGPSVFPLAPSSKSTSG
GTAALGCLVKDYFPEPVTVSWNSGALTSGVHTFPAVLQSSGLYSLSSVVT
VPSSSLGTQTYICNVNHKPSNTKVDKRVEPKSCDKTHTCPPCPAPELLGG
PSVFLFPPKPKDTLMISRTPEVTCVVVDVSHEDPEVKFNWYVDGVEHNA
KTKPREEQYNSTYRVVSVLTVLHQDWLNGKEYKCKVSNKALPAPIEKTIS
KAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHY
TQKSLSLSPGK

1456_P20 (PG20) gamma heavy chain variable region amino acid sequence: (Kabat CDRs underlined, Chothia CDRs in bold italics)

(SEQ ID NO: 33)
QVRLVQSGPEVKKPGSSVTVSCQAS*GGTFSS*YAFTWVRQAPGQGLEW

LG*MVTPIFGEAK*RVTITADESTSTTSIELRGLTSEDTAIY

YCAR*DRRAVPIATDNWLDP*WGQGTLVTVSS

1456_P20 (PG20) gamma heavy chain Kabat CDRs:

(SEQ ID NO: 104)
CDR 1: SYAFT (SEQ ID NO: 105)
CDR 2: MVTPIFGEAKYSQRFEG (SEQ ID NO: 9)
CDR 3: DRRAVPIATDNWLDP

1456_P20 (PG20) gamma heavy chain Chothia CDRs:

(SEQ ID NO: 268)
CDR 1: GGTFSS (SEQ ID NO: 269)
CDR 2: MVTPIFGEAK (SEQ ID NO: 9)
CDR 3: DRRAVPIATDNWLDP

1456_P20 (PG20) kappa light chain nucleotide sequence:
1456_P20 κ1 coding sequence (variable region in bold)

(SEQ ID NO: 17)
ATGGACATGAGGGTCCCCGCTCAGCTCCTGGGGCTCCTGCTACTCTGG
CTCCGAGGTGCCAGATGTGACATCCAGTTGACCCAGTCTCCATCCTC
CCTGTCTGCATCTGTTGGCGACAGAGTCTCCATCACTTGCCGGGC
GAGTCAGACCATTAACAACTACTTAAATTGGTATCAACAGACACCC
GGGAAAGCCCCTAAACTCCTGATCTATGGTGCCTCCAATTTGCAA
AATGGGGTCCCATCAAGGTTCAGCGGCAGTGGCTCTGGGACAGAC
TTCACTCTCACCATCAGCAGTCTGCAACCTGAGGATTTTGCAACTT
ACTACTGTCAACAGAGTTTCAGTACTCCGAGGACCTTCGGCCAAG
GGACACGACTGGATATTAAACGTACGGTGGCTGCACCATCTGTCTTC
ATCTTCCCGCCATCTGATGAGCAGTTGAAATCTGGAACTGCCTCTGTTG

TGTGCCTGCTGAATAACTTCTATCCCAGAGAGGCCAAAGTACAGTGGA
AGGTGGATAACGCCCTCCAATCGGGTAACTCCCAGGAGAGTGTCACAG
AGCAGGACAGCAAGGACAGCACCTACAGCCTCAGCAGCACCCTGACG
CTGAGCAAAGCAGACTACGAGAAACACAAAGTCTACGCCTGCGAAGT
CACCCATCAGGGCCTGAGCTCGCCCGTCACAAAGAGCTTCAACAGGGG
AGAGTGTTAG

1456_P20 (PG201 kappa light chain variable region nucleotide sequence:

(SEQ ID NO: 106)
GACATCCAGTTGACCCAGTCTCCATCCTCCCTGTCTGCATCTGTTGGCG
ACAGAGTCTCCATCACTTGCCGGGCGAGTCAGACCATTAACAACTACT
TAAATTGGTATCAACAGACACCCGGGAAAGCCCCTAAACTCCTGATCT
ATGGTGCCTCCAATTTGCAAAATGGGGTCCCATCAAGGTTCAGCGGCA
GTGGCTCTGGGACAGACTTCACTCTCACCATCAGCAGTCTGCAACCTG
AGGATTTTGCAACTTACTACTGTCAACAGAGTTTCAGTACTCCGAGGA
CCTTCGGCCAAGGGACACGACTGGATATTAAA

1456_P20 (PG20) kappa light chain amino acid sequence: expressed protein with variable region in bold.

(SEQ ID NO: 18)
DIQLTQSPSSLSASVGDRVSITCRASQTINNYLNWYQQTPGKAPKLLIY
GASNLQNGVPSRFSGSGSGTDFTLTISSLQPEDFATYYCQQSFSTPRTF
GQGTRLDIKRTVAAPSVFIFPPSDEQLKSGTASVVCLLNNFYPREAKVQW
KVDNALQSGNSQESVTEQDSKDSTYSLSSTLTLSKADYEKHKVYACEVTH
QGLSSPVTKSFNRGEC

1456_P20 (PG20) kappa light chain variable region amino acid sequence: (Kabat CDRs underlined Chothia CDRs in hold italics)

(SEQ ID NO: 34)
DIQLTQSPSSLSASVGDRVSITC*RASQTINNYLN*WYQQTP

GKAPKLLIY*GASNLQN*GVPSRFSGSGSGTDFTLTISSLQPEDFAT

YYC*QQSFSTPRT*FGQGTRLDIK

1456_P20 (PG20) kappa light chain Kabat CDRs:

(SEQ ID NO: 107)
CDR 1: RASQTINNYLN (SEQ ID NO: 108)
CDR 2: GASNLQN (SEQ ID NO: 42)
CDR 3: QQSFSTPRT

1456_P20 (PG20) kappa light chain Chothia CDRs:

(SEQ ID NO: 107)
CDR 1: RASQTINNYLN (SEQ ID NO: 108)
CDR 2: GASNLQN

CDR 3: QQSFSTPRT (SEQ ID NO: 42)

1460_G14 (PGG14) gamma heavy chain nucleotide sequence: 1460_G14 γ1 coding sequence (variable region in bold)

(SEQ ID NO: 19)
ATGGACTGGATTTGGAGGTTCCTCTTGGTGGTGGCAGCAGCTACAGGT
GTCCAGTCCCAGGTCCTGCTGGTGCAGTCTGGGACTGAGGTGAAG
AAGCCTGGGTCCTCGGTGAAGGTCTCCTGTCAGGCTTCTGGAGGC
GCCTTCAGTAGTTATGCTTTCAGCTGGGTGCGACAGGCCCCTGGA
CAGGGGCTTGAATGGATGGGCATGATCACCCCTGTCTTTGGTGAG
ACTAAATATGCACCGAGGTTCCAGGGCAGACTCACACTTACCGCG
GAAGAATCCTTGAGCACCACCTACATGGAATTGAGAAGCCTGACA
TCTGATGACACGGCCTTTTATTATTGTACGAGAGATCGGCGCGTA
GTTCCAATGGCCACAGACAACTGGTTAGACCCCTGGGGCCAGGGG
ACGCTGGTCACCGTCTCGAGCGCCTCCACCAAGGGCCCATCGGTCTT
CCCCCTGGCACCCTCCTCCAAGAGCACCTCTGGGGGCACAGCGGCCCT
GGGCTGCCTGGTCAAGGACTACTTCCCCGAACCGGTGACGGTGTCGTG
GAACTCAGGCGCCCTGACCAGCGGCGTGCACACCTTCCCGGCTGTCCT
ACAGTCCTCAGGACTCTACTCCCTCAGCAGCGTGGTGACCGTGCCCTC
CAGCAGCTTGGGCACCCAGACCTACATCTGCAACGTGAATCACAAGCC
CAGCAACACCAAGGTGGACAAGAGAGTTGAGCCCAAATCTTGTGACA
AAACTCACACATGCCCACCGTGCCCAGCACCTGAACTCCTGGGGGGAC
CGTCAGTCTTCCTCTTCCCCCCAAAACCCAAGGACACCCTCATGATCTC
CCGGACCCCTGAGGTCACATGCGTGGTGGTGGACGTGAGCCACGAAG
ACCCTGAGGTCAAGTTCAACTGGTACGTGGACGGCGTGGAGGTGCATA
ATGCCAAGACAAAGCCGCGGGAGGAGCAGTACAACAGCACGTACCGT
GTGGTCAGCGTCCTCACCGTCCTGCACCAGGACTGGCTGAATGGCAAG
GAGTACAAGTGCAAGGTCTCCAACAAAGCCCTCCCAGCCCCCATCGAG
AAAACCATCTCCAAAGCCAAAGGGCAGCCCCGAGAACCACAGGTGTA
CACCCTGCCCCCATCCCGGGAGGAGATGACCAAGAACCAGGTCAGCCT
GACCTGCCTGGTCAAAGGCTTCTATCCCAGCGACATCGCCGTGGAGTG
GGAGAGCAATGGGCAGCCGGAGAACAACTACAAGACCACGCCTCCCG
TGCTGGACTCCGACGGCTCCTTCTTCCTCTATAGCAAGCTCACCGTGGA
CAAGAGCAGGTGGCAGCAGGGGAACGTCTTCTCATGCTCCGTGATGCA
TGAGGCTCTGCACAACCACTACACGCAGAAGAGCCTCTCCCTGTCTCC
GGGTAAATGA

1460_G14 (PGG14) gamma heavy chain variable region nucleotide sequence:

(SEQ ID NO: 109)
CAGGTCCTGCTGGTGCAGTCTGGGACTGAGGTGAAGAAGCCTGGGTCC
TCGGTGAAGGTCTCCTGTCAGGCTTCTGGAGGCGCCTTCAGTAGTTATG
CTTTCAGCTGGGTGCGACAGGCCCCTGGACAGGGGCTTGAATGGATGG
GCATGATCACCCCTGTCTTTGGTGAGACTAAATATGCACCGAGGTTCC
AGGGCAGACTCACACTTACCGCGGAAGAATCCTTGAGCACCACCTACA
TGGAATTGAGAAGCCTGACATCTGATGACACGGCCTTTTATTATTGTAC
GAGAGATCGGCGCGTAGTTCCAATGGCCACAGACAACTGGTTAGACCC
CTGGGGCCAGGGGACGCTGGTCACCGTCTCGAGC

1460_G14 gamma heavy chain amino acid sequence: expressed protein with variable region in bold.

(SEQ ID NO: 20)
QVLLVQSGTEVKKPGSSVKVSCQASGGAFSSYAFSWVRQAPGQGLE
WMGMITPVFGETKYAPRFQGRLTLTAEESLSTTYMELRSLTSDDTAF
YYCTRDRRVVPMATDNWLDPWGQGTLVTVSSASTKGPSVFPLAPSSKS
TSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEL
LGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALPAPIEK
TISKAKGQPREPQVYTLPPSREEMTKNQVSLTCLVKGFYPSDIAVEWESN
GQPENNYKTTPPVLDSDGSFFLYSKLTVDKSRWQQGNVFSCSVMHEALH
NHYTQKSLSLSPG

1460_G14 gamma heavy chain variable region amino acid sequence: (Kabat CDRs underlined, Chothia CDRs in bold italics)

(SEQ ID NO: 35)
QVLLVQSGTEVKKPGSSVKVSCQAS*GGAFSS*<u>YAFS</u>WVRQAPGQGLEW
MG*M* *ITPVFGETK*<u>YAPRFQG</u>RLTLTAEESLSTTYMELRSLTSDDTAFY
YCTR<u>*DRRVVPMATDNWLDP*</u>WGQGTLVTVSS

1460_G14 gamma heavy chain Kabat CDRs:

(SEQ ID NO: 110)
CDR 1: SYAFS (SEQ ID NO: 111)
CDR 2: MITPVFGETKYAPRFQG (SEQ ID NO: 8)
CDR 3: DRRVVPMATDNWLDP

1460_G14 gamma heavy chain Chothia CDRs:

(SEQ ID NO: 270)
CDR 1: GGAFSS (SEQ ID NO: 271)
CDR 2: MITPVFGETK (SEQ ID NO: 8)
CDR 3: DRRVVPMATDNWLDP

1460_G14 (PGG14) kappa light chain nucleotide sequence: 1460_G14 κ1 coding sequence (variable region in bold)

(SEQ ID NO: 21)
ATGGACATGAGGGTCCCCGCTCAGCTCCTGGGGCTCCTGCTCCTCTGG
CTCCGAGGTGCCACATGTGACATCCAGTTGACCCAGTCTCCATCCTC
CCTGTCTGCATCTGTAGGAGACAGGGTCACCGTCACTTGCCGGGC
GAGTCAGACCATACACACCTATTTAAATTGGTATCAGCAAATTCCA
GGAAAAGCCCCTAAGCTCCTGATCTATGGTGCCTCCACCTTGCAA
AGTGGGGTCCCGTCAAGGTTCAGTGGCAGTGGATCTGGGACAGAT
TTCACTCTCACCATCAACAGTCTCCAACCTGAGGACTTTGCAACTT
ACTACTGTCAACAGAGTTACAGTACCCCAAGGACCTTCGGCCAAG
GGACACGACTGGATATTAAACGTACGGTGGCTGCACCATCTGTCTTC
ATCTTCCCGCCATCTGATGAGCAGTTGAAATCTGGAACTGCCTCTGTTG
TGTGCCTGCTGAATAACTTCTATCCCAGAGAGGCCAAAGTACAGTGGA
AGGTGGATAACGCCCTCCAATCGGGTAACTCCCAGGAGAGTGTCACAG
AGCAGGACAGCAAGGACAGCACCTACAGCCTCAGCAGCACCCTGACG
CTGAGCAAAGCAGACTACGAGAAACACAAAGTCTACGCCTGCGAAGT
CACCCATCAGGGCCTGAGCTCGCCCGTCACAAAGAGCTTCAACAGGGG
AGAGTGTTAG

1460_G14 (PGG14) kappa light chain variable region nucleotide sequence:

(SEQ ID NO: 112)
GACATCCAGTTGACCCAGTCTCCATCCTCCCTGTCTGCATCTGTAGGAG
ACAGGGTCACCGTCACTTGCCGGGCGAGTCAGACCATACACACCTATT
TAAATTGGTATCAGCAAATTCCAGGAAAAGCCCCTAAGCTCCTGATCT
ATGGTGCCTCCACCTTGCAAAGTGGGGTCCCGTCAAGGTTCAGTGGCA
GTGGATCTGGGACAGATTTCACTCTCACCATCAACAGTCTCCAACCTG
AGGACTTTGCAACTTACTACTGTCAACAGAGTTACAGTACCCCAAGGA
CCTTCGGCCAAGGGACACGACTGGATATTAAA

1460_G14 kappa light chain amino acid sequence: expressed protein with variable region in bold.

(SEQ ID NO: 22)
DIQLTQSPSSLSASVGDRVTVTCRASQTIHTYLNWYQQIPGKAPKLLIY
GASTLQSGVPSRFSGSGSGTDFTLTINSLQPEDFATYYCQQSYSTPRTF
GQGTRLDIKRTVAAPSVFIFPPSDEQLKSGTASVVCLLNNFYPREAKVQW
KVDNALQSGNSQESVTEQDSKDSTYSLSSTLTLSKADYEKHKVYACEVTH
QGLSSPVTKSFNRGEC

1460_G14 kappa light chain variable region amino acid sequence: (Kabat CDRs underlined, Chothia CDRs in bold italics)

(SEQ ID NO: 36)
DIQLTQSPSSLSASVGDRVTVTC*__RASQTIHTYLN__*WYQQIPGKAPKLLIY
*__GASTLQS__*GVPSRFSGSGSGTDFTLTINSLQPEDFATYYC*__QQSYSTPRT__*
FGQGTRLDIK

1460_G14 kappa light chain Kabat CDRs:

(SEQ ID NO: 113)
CDR 1: RASQTIHTYLN (SEQ ID NO: 114)
CDR 2: GASTLQS (SEQ ID NO: 43)
CDR 3: QQSYSTPRT

1460_G14 kappa light chain Chothia CDRs:

(SEQ ID NO: 113)
CDR 1: RASQTIHTYLN (SEQ ID NO: 114)
CDR 2: GASTLQS (SEQ ID NO: 43)
CDR 3: QQSYSTPRT

1495_C14 (PGC14) gamma heavy chain nucleotide sequence: 1495_C14 γ1 coding sequence (variable region in bold)

(SEQ ID NO: 23)
ATGGACTGGATTTGGAGGATCCTCCTCTTGGTGGCAGCAGCTACAGGC
ACCCTCGCCGACGGCCACCTGGTTCAGTCTGGGGTTGAGGTGAAG
AAGACTGGGGCTACAGTCAAAATCTCCTGCAAGGTTTCTGGATAC
AGCTTCATCGACTACTACCTTCATTGGGTGCAACGGGCCCCTGGA
AAAGGCCTTGAGTGGGTGGGACTTATTGATCCTGAAAATGGTGAG
GCTCGATATGCAGAGAAGTTCCAGGGCAGAGTCACCATAATCGCG
GACACGTCTATAGATACAGGCTACATGGAAATGAGGAGCCTGAAA
TCTGAGGACACGGCCGTGTATTTCTGTGCAGCAGGTGCCGTGGGG
GCTGATTCCGGGAGCTGGTTCGACCCCTGGGGCCAGGGAACTCTG
GTCACCGTCTCGAGCGCCTCCACCAAGGGCCCATCGGTCTTCCCCCT
GGCACCCTCCTCCAAGAGCACCTCTGGGGGCACAGCGGCCCTGGGCTG
CCTGGTCAAGGACTACTTCCCCGAACCGGTGACGGTGTCGTGGAACTC
AGGCGCCCTGACCAGCGGCGTGCACACCTTCCCGGCTGTCCTACAGTC
CTCAGGACTCTACTCCCTCAGCAGCGTGGTGACCGTGCCCTCCAGCAG
CTTGGGCACCCAGACCTACATCTGCAACGTGAATCACAAGCCCAGCAA
CACCAAGGTGGACAAGAGAGTTGAGCCCAAATCTTGTGACAAAACTC
ACACATGCCCACCGTGCCCAGCACCTGAACTCCTGGGGGGACCGTCAG
TCTTCCTCTTCCCCCCAAAACCCAAGGACACCCTCATGATCTCCCGGAC
CCCTGAGGTCACATGCGTGGTGGTGGACGTGAGCCACGAAGACCCTGA
GGTCAAGTTCAACTGGTACGTGGACGGCGTGGAGGTGCATAATGCCAA
GACAAAGCCGCGGGAGGAGCAGTACAACAGCACGTACCGTGTGGTCA
GCGTCCTCACCGTCCTGCACCAGGACTGGCTGAATGGCAAGGAGTACA
AGTGCAAGGTCTCCAACAAAGCCCTCCCAGCCCCCATCGAGAAACCA
TCTCCAAAGCCAAAGGGCAGCCCCGAGAACCACAGGTGTACACCCTG
CCCCCATCCCGGGAGGAGATGACCAAGAACCAGGTCAGCCTGACCTG
CCTGGTCAAAGGCTTCTATCCCAGCGACATCGCCGTGGAGTGGGAGAG

```
CAATGGGCAGCCGGAGAACAACTACAAGACCACGCCTCCCGTGCTGG

ACTCCGACGGCTCCTTCTTCCTCTATAGCAAGCTCACCGTGGACAAGA

GCAGGTGGCAGCAGGGGAACGTCTTCTCATGCTCCGTGATGCATGAGG

CTCTGCACAACCACTACACGCAGAAGAGCCTCTCCCTGTCTCCGGGTA

AATGA
```

1495_C14 (PGC14) gamma heavy chain variable region nucleotide sequence:

```
                                      (SEQ ID NO: 115)
GACGGCCACCTGGTTCAGTCTGGGGTTGAGGTGAAGAAGACTGGGGCT

ACAGTCAAAATCTCCTGCAAGGTTTCTGGATACAGCTTCATCGACTACT

ACCTTCATTGGGTGCAACGGGCCCCTGGAAAAGGCCTTGAGTGGGTGG

GACTTATTGATCCTGAAAATGGTGAGGCTCGATATGCAGAGAAGTTCC

AGGGCAGAGTCACCATAATCGCGGACACGTCTATAGATACAGGCTACA

TGGAAATGAGGAGCCTGAAATCTGAGGACACGGCCGTGTATTTCTGTG

CAGCAGGTGCCGTGGGGGCTGATTCCGGGAGCTGGTTCGACCCCTGGG

GCCAGGGAACTCTGGTCACCGTCTCGAGC
```

1495_C14 (PGC14) gamma heavy chain amino acid sequence: expressed protein with variable region in bold.

```
                                       (SEQ ID NO: 24)
DGHLVQSGVEVKKTGATVKISCKVSGYSFIDYYLHWVQRAPGKGLE

WVGLIDPENGEARYAEKFQGRVTIIADTSIDTGYMEMRSLKSEDTAV

YFCAAGAVGADSGSWFDPWGQGTLVTVSSASTKGPSVFPLAPSSKSTS

GGTAALGCLVKDYFPEPVTVSWNSGALTSGVHTFPAVLQSSGLYSLSSVV

TVPSSSLGTQTYICNVNHKPSNTKVDKRVEPKSCDKTHTCPPCPAPELLGG

PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHY

TQKSLSLSPGK
```

1495_C14 (PGC14) gamma heavy chain variable region amino acid sequence: (Kabat CDRs underlined, Chothia CDRs in bold italics)

```
                                       (SEQ ID NO: 37)
DGHLVQSGVEVKKTGATVKISCKVS*GYSFID*YYLHWVQRAPGKGLEW

VG*LIDPENGEAR*RVTIIADTSIDTGYMEMRSLKSEDTAVY

FCAA*GAVGADSGSWFDP*WGQGTLVTVSS
```

1495_C14 gamma heavy chain Kabat CDRs:

```
                                      (SEQ ID NO: 116)
                    CDR 1: DYYLH (SEQ ID NO: 117)
       CDR 2: LIDPENGEARYAEKFQG
```

```
                                       (SEQ ID NO: 10)
              CDR 3: GAVGADSGSWFDP
```

1495_C14 gamma heavy chain Chothia CDRs:

```
                                      (SEQ ID NO: 102)
                    CDR 1: GYSFID (SEQ ID NO: 103)
                CDR 2: LIDPENGEAR (SEQ ID NO: 10)
              CDR 3: GAVGADSGSWFDP
```

1495_C14 (PGC14) lambda light chain nucleotide sequence: 1495_C14 λ3 coding sequence (variable region in bold)

```
                                       (SEQ ID NO: 25)
ATGGCCTGGATCCCTCTCTTCCTCGGCGTCCTTGCTTACTGCACAGATT

CCGTAGTCTCCTATGAACTGACTCAGCCACCCTCAGTGTCCGTGTC

CCCAGGACAGACAGCCAGCATCACCTGTTCTGGATCTAAATTGGG

GGATAAATATGTTTCCTGGTATCAACTGAGGCCAGGCCAGTCCCC

CATACTGGTCATGTATGAAAATGACAGGCGGCCCTCCGGGATCCC

TGAGCGATTCTCCGGTTCCAATTCTGGCGACACTGCCACTCTGAC

CATCAGCGGGACCCAGGCTTTGGATGAGGCTGACTTCTACTGTCA

GGCGTGGGAGACCACCACCACCACTTTTGTTTTCTTCGGCGGAGG

GACCCAGCTGACCGTTCTAGGTCAGCCCAAGGCTGCCCCCTCGGTCA

CTCTGTTCCCGCCCTCCTCTGAGGAGCTTCAAGCCAACAAGGCCACAC

TGGTGTGTCTCATAAGTGACTTCTACCCGGGAGCCGTGACAGTGGCCT

GGAAGGCAGATAGCAGCCCCGTCAAGGCGGGAGTGGAGACCACCACA

CCCTCCAAACAAAGCAACAACAAGTACGCGGCCAGCAGCTACCTGAG

CCTGACGCCTGAGCAGTGGAAGTCCCACAAAAGCTACAGCTGCCAGGT

CACGCATGAAGGGAGCACCGTGGAGAAGACAGTGGCCCCTACAGAAT

GTTCATAG
```

1495_C14 (PGC14) lambda light chain variable region nucleotide sequence:

```
                                      (SEQ ID NO: 119)
TCCTATGAACTGACTCAGCCACCCTCAGTGTCCGTGTCCCCAGGACAG

ACAGCCAGCATCACCTGTTCTGGATCTAAATTGGGGGATAAATATGTT

TCCTGGTATCAACTGAGGCCAGGCCAGTCCCCCATACTGGTCATGTAT

GAAAATGACAGGCGGCCCTCCGGGATCCCTGAGCGATTCTCCGGTTCC

AATTCTGGCGACACTGCCACTCTGACCATCAGCGGGACCCAGGCTTTG

GATGAGGCTGACTTCTACTGTCAGGCGTGGGAGACCACCACCACCACT

TTTGTTTTCTTCGGCGGAGGGACCCAGCTGACCGTTCTA
```

1495_C14 (PGC14) lambda light chain amino acid sequence: expressed protein with variable region in bold.

```
                                       (SEQ ID NO: 26)
SYELTQPPSVSVSPGQTASITCSGSKLGDKYVSWYQLRPGQSPILVMY
```

ENDRRPSGIPERFSGSNSGDTATLTISGTQALDEADFYCQAWETTTTT
FVFFGGGTQLTVLGQPKAAPSVTLFPPSSEELQANKATLVCLISDFYPGA
VTVAWKADSSPVKAGVETTTPSKQSNNKYAASSYLSLTPEQWKSHKSYS
CQVTHEGSTVEKTVAPTECS

1495_C14 (PGC14) lambda light chain variable region amino acid sequence: (Kabat CDRs underlined, Chothia CDRs in bold italics)

(SEQ ID NO: 38)
SYELTQPPSVSVSPGQTASITC*SGSKLGDKYVS*WYQLRPGQSPILVM
Y*ENDRRPS*GIPERFSGSNSGDTATLTISGTQALDEADFYC
*QAWETTTTTFVF*FGGGTQLTVL

1495_C14 (PGC14) lambda light chain Kabat CDRs:

(SEQ ID NO: 120)
CDR 1: SGSKLGDKYVS (SEQ ID NO: 121)
CDR 2: ENDRRPS (SEQ ID NO: 44)
CDR 3: QAWETTTTTFVF

1495_C14 (PGC14) lambda light chain Chothia CDRs:

(SEQ ID NO: 120)
CDR 1: SGSKLGDKYVS (SEQ ID NO: 121)
CDR 2: ENDRRPS (SEQ ID NO: 44)
CDR 3: QAWETTTTTFVF

1496_C09 (PG9) (TCN-109) gamma heavy chain nucleotide sequence: 1496_C09 γ3 coding sequence (variable region in bold)

(SEQ ID NO: 27)
ATGGAGTTTGGGCTGAGCTGGGTTTTCCTCGTTGCTTTCTTAAGAGGTG
TCCAGTGT**CAGCGATTAGTGGAGTCTGGGGGAGGCGTGGTCCAGC
CTGGGTCGTCCCTGAGACTCTCCTGTGCAGCGTCCGGATTCGACT
TCAGTAGACAAGGCATGCACTGGGTCCGCCAGGCTCCAGGCCAGG
GGCTGGAGTGGGTGGCATTTATTAAATATGATGGAAGTGAGAAAT
ATCATGCTGACTCCGTATGGGGCCGACTCAGCATCTCCAGAGACA
ATTCCAAGGATACGCTTTATCTCCAAATGAATAGCCTGAGAGTCGA
GGACACGGCTACATATTTTTGTGTGAGAGAGGCTGGTGGGCCCGA
CTACCGTAATGGGTACAACTATTACGATTTCTATGATGGTTATTAT
AACTACCACTATATGGACGTCTGGGGCAAAGGGACCACGGTCACC
GTCTCGAGC**GCCTCCACCAAGGGCCCATCGGTCTTCCCCCTGGCACCC
TCCTCCAAGAGCACCTCTGGGGGCACAGCGGCCCTGGGCTGCCTGGTC
AAGGACTACTTCCCCGAACCGGTGACGGTGTCGTGGAACTCAGGCGCC
CTGACCAGCGGCGTGCACACCTTCCCGGCTGTCCTACAGTCCTCAGGA
CTCTACTCCCTCAGCAGCGTGGTGACCGTGCCCTCCAGCAGCTTGGGC
ACCCAGACCTACATCTGCAACGTGAATCACAAGCCCAGCAACACCAA
GGTGGACAAGAGAGTTGAGCCCAAATCTTGTGACAAAACTCACACATG
CCCACCGTGCCCAGCACCTGAACTCCTGGGGGGACCGTCAGTCTTCCT
CTTCCCCCCAAAACCCAAGGACACCCTCATGATCTCCCGGACCCCTGA
GGTCACATGCGTGGTGGTGGACGTGAGCCACGAAGACCCTGAGGTCA
AGTTCAACTGGTACGTGGACGGCGTGGAGGTGCATAATGCCAAGACA
AAGCCGCGGGAGGAGCAGTACAACAGCACGTACCGTGTGGTCAGCGT
CCTCACCGTCCTGCACCAGGACTGGCTGAATGGCAAGGAGTACAAGTG
CAAGGTCTCCAACAAAGCCCTCCCAGCCCCCATCGAGAAAACCATCTC
CAAAGCCAAAGGGCAGCCCCGAGAACCACAGGTGTACACCCTGCCCC
CATCCCGGGAGGAGATGACCAAGAACCAGGTCAGCCTGACCTGCCTG
GTCAAAGGCTTCTATCCCAGCGACATCGCCGTGGAGTGGGAGAGCAAT
GGGCAGCCGGAGAACAACTACAAGACCACGCCTCCCGTGCTGGACTC
CGACGGCTCCTTCTTCCTCTATAGCAAGCTCACCGTGGACAAGAGCAG
GTGGCAGCAGGGGAACGTCTTCTCATGCTCCGTGATGCATGAGGCTCT
GCACAACCACTACACGCAGAAGAGCCTCTCCCTGTCTCCGGGTAAATG
A

1496_C09 (PG9) (TCN-109) gamma heavy chain variable region nucleotide sequence:

(SEQ ID NO: 122)
CAGCGATTAGTGGAGTCTGGGGGAGGCGTGGTCCAGCCTGGGTCGTCC
CTGAGACTCTCCTGTGCAGCGTCCGGATTCGACTTCAGTAGACAAGGC
ATGCACTGGGTCCGCCAGGCTCCAGGCCAGGGGCTGGAGTGGGTGGC
ATTTATTAAATATGATGGAAGTGAGAAATATCATGCTGACTCCGTATG
GGGCCGACTCAGCATCTCCAGAGACAATTCCAAGGATACGCTTTATCT
CCAAATGAATAGCCTGAGAGTCGAGGACACGGCTACATATTTTTGTGT
GAGAGAGGCTGGTGGGCCCGACTACCGTAATGGGTACAACTATTACGA
TTTCTATGATGGTTATTATAACTACCACTATATGGACGTCTGGGGCAAA
GGGACCACGGTCACCGTCTCGAGC

1496_C09 (PG9) (TCN-109) gamma heavy chain amino acid sequence: expressed protein with variable region in bold.

(SEQ ID NO: 28)
**QRLVESGGGVVQPGSSLRLSCAASGFDFSRQGMHWVRQAPGQGLEWVA
FIKYDGSEKYHADSVWGRLSISRDNSKDTLYLQMNSLRVEDTATYFCVRE
AGGPDYRNGYNYYDFYDGYYNYHYMDVWGKGTTVTVSS**ASTKGPSVFP
LAPSSKSTSGGTAALGCLVKDYFPEPVTVSWNSGALTSGVHTFPAVLQSS
GLYSLSSVVTVPSSSLGTQTYICNVNHKPSNTKVDKRVEPKSCDKTHTCP
PCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNK

ALPAPIEKTISKAKGQPREPQVYTLPPSREEMTKNQVSLTCLVKGFYPSD

IAVEWESNGQPENNYKTTPPVLDSDGSFFLYSKLTVDKSRWQQGNVFSCS

VMHEALHNHYTQKSLSLSPGK

1496_C09 (PG9) (TCN-109) gamma heavy chain variable region amino acid sequence:
(Kabat CDRs underlined, Chothia CDRs in bold italics)

(SEQ ID NO: 39)
QRLVESGGGVVQPGSSLRLSCAAS*GFDFSR*<u>QGMH</u>WVRQAPGQGLEW

VA*FIKYDGSEKY*RLSISRDNSKDTLYLQMNSLRVEDTATY

FCVR*EAGGPDYRNGYNYYDFYDGYYNYHYMDV*WGKGTTVTVSS

1496_C09 (PG9) (TCN-109) gamma heavy chain Kabat CDRs:

(SEQ ID NO: 123)
CDR 1: RQGMH (SEQ ID NO: 124)
CDR 2: FIKYDGSEKYHADSVWG (SEQ ID NO: 7)
CDR 3: EAGGPDYRNGYNYYDFYDGYYNYHYMDV

1496_C09 (PG9) (TCN-109) gamma heavy chain Chothia CDRs:

(SEQ ID NO: 118)
CDR 1: GFDFSR (SEQ ID NO: 272)
CDR 2: FIKYDGSEKY (SEQ ID NO: 7)
CDR 3: EAGGPDYRNGYNYYDFYDGYYNYHYMDV

1496_C09 (PG9) (TCN-109) lambda light chain nucleotide sequence: 1496_C09 λ2 coding sequence (variable region in bold)

(SEQ ID NO: 29)
ATGGCCTGGGCTCTGCTTTTCCTCACCCTCCTCACTCAGGGCACAGGGT

CCTGGGCCCAGTCTGCCCTGACTCAGCCTGCCTCCGTGTCTGGGTC

TCCTGGACAGTCGATCACCATCTCCTGCAATGGAACCAGCAATGA

TGTTGGTGGCTATGAATCTGTCTCCTGGTACCAACAACATCCCGG

CAAAGCCCCCAAAGTCGTGATTTATGATGTCAGTAAACGGCCCTC

AGGGGTTTCTAATCGCTTCTCTGGCTCCAAGTCCGGCAACACGGC

CTCCCTGACCATCTCTGGGCTCCAGGCTGAGGACGAGGGTGACTA

TTACTGCAAGTCTCTGACAAGCACGAGACGTCGGGTTTTCGGCAC

TGGGACCAAGCTGACCGTTCTAGGTCAGCCCAAGGCTGCCCCCTCGG

TCACTCTGTTCCCGCCCTCCTCTGAGGAGCTTCAAGCCAACAAGGCCA

CACTGGTGTGTCTCATAAGTGACTTCTACCCGGGAGCCGTGACAGTGG

CCTGGAAGGCAGATAGCAGCCCCGTCAAGGCGGGAGTGGAGACCACC

ACACCCTCCAAACAAAGCAACAACAAGTACGCGGCCAGCAGCTACCT

GAGCCTGACGCCTGAGCAGTGGAAGTCCCACAAAAGCTACAGCTGCC

AGGTCACGCATGAAGGGAGCACCGTGGAGAAGACAGTGGCCCCTACA

GAATGTTCATAG

1496_C09 (PG9) (TCN-109) lambda light chain variable region nucleotide sequence:

(SEQ ID NO: 125)
CAGTCTGCCCTGACTCAGCCTGCCTCCGTGTCTGGGTCTCCTGGACAGT

CGATCACCATCTCCTGCAATGGAACCAGCAATGATGTTGGTGGCTATG

AATCTGTCTCCTGGTACCAACAACATCCCGGCAAAGCCCCCAAAGTCG

TGATTTATGATGTCAGTAAACGGCCCTCAGGGGTTTCTAATCGCTTCTC

TGGCTCCAAGTCCGGCAACACGGCCTCCCTGACCATCTCTGGGCTCCA

GGCTGAGGACGAGGGTGACTATTACTGCAAGTCTCTGACAAGCACGAG

ACGTCGGGTTTTCGGCACTGGGACCAAGCTGACCGTTCTA

1496_C09 (PG9) (TCN-109) lambda light chain amino acid sequence: expressed protein with variable region in bold.

(SEQ ID NO: 30)
QSALTQPASVSGSPGQSITISCNGTSNDVGGYESVSWYQQHPGKAPKV

VIYDVSKRPSGVSNRFSGSKSGNTASLTISGLQAEDEGDYYCKSLTSTR

RRVFGTGTKLTVLGQPKAAPSVTLFPPSSEELQANKATLVCLISDFYPGA

VTVAWKADSSPVKAGVETTTPSKQSNNKYAASSYLSLTPEQWKSHKSYS

CQVTHEGSTVEKTVAPTECS

1496_C09 (PG9) (TCN-109) lambda light chain variable region amino acid sequence: (Kabat CDRs underlined, Chothia CDRs in bold italics)

(SEQ ID NO: 40)
QSALTQPASVSGSPGQSITISC*NGTSNDVGGYESVS*WYQQHPGKAPK

VVIY*DVSKRPS*GVSNRFSGSKSGNTASLTISGLQAEDEGDYYC

*KSLTSTRRRV*FGTGTKLTVL

1496_C09 (PG9) (TCN-109) lambda light chain Kabat CDRs:

(SEQ ID NO: 126)
CDR 1: NGTSNDVGGYESVS (SEQ ID NO: 127)
CDR 2: DVSKRPS (SEQ ID NO: 45)
CDR 3: KSLTSTRRRV

1496_C09 (PG9) (TCN-109) lambda light chain Chothia CDRs:

(SEQ ID NO: 126)
CDR 1: NGTSNDVGGYESVS (SEQ ID NO: 127)
CDR 2: DVSKRPS (SEQ ID NO: 45)
CDR 3: KSLTSTRRRV

The 1443_C16 (PG16) antibody includes a heavy chain variable region (SEQ ID NO: 31), encoded by the nucleic acid sequence shown in SEQ ID NO: 99, and a light chain variable region (SEQ ID NO: 32) encoded by the nucleic acid sequence shown in SEQ ID NO: 100.

The heavy chain CDRs of the 1443_C16 (PG16) antibody have the following sequences per Kabat definition: KYGMH (SEQ ID NO: 88), LISDDGMRKYHSDSMWG (SEQ ID NO: 89), and EAGGPIWHDDVKYYDFNDGYYNYHYMDV (SEQ ID NO: 6). The light chain CDRs of the 1443_C16 (PG16) antibody have the following sequences per Kabat definition: NGTSSDVGGFDSVS (SEQ ID NO: 97), DVSHRPS (SEQ ID NO: 95), and SSLTDRSHRI (SEQ ID NO: 41).

The heavy chain CDRs of the 1443_C16 (PG16) antibody have the following sequences per Chothia definition: GFTFHK (SEQ ID NO: 266), LISDDGMRKY (SEQ ID NO: 267), and EAGGPIWHDDVKYYDFNDGYYNYHYMDV (SEQ ID NO: 6). The light chain CDRs of the 1443_C16 (PG16) antibody have the following sequences per Chothia definition: NGTSSDVGGFDSVS (SEQ ID NO: 97), DVSHRPS (SEQ ID NO: 95), and SSLTDRSHRI (SEQ ID NO: 41).

The 1456_P20 (PG20) antibody includes a heavy chain variable region (SEQ ID NO: 33), encoded by the nucleic acid sequence shown in SEQ ID NO: 101, and a light chain variable region (SEQ ID NO: 34) encoded by the nucleic acid sequence shown in SEQ ID NO: 106.

The heavy chain CDRs of the 1456_P20 (PG20) antibody have the following sequences per Kabat definition: SYAFT (SEQ ID NO: 104), MVTPIFGEAKYSQRFEG (SEQ ID NO: 105), and DRRAVPIATDNWLDP (SEQ ID NO: 9). The light chain CDRs of the 1456_P20 (PG20) antibody have the following sequences per Kabat definition: RASQTINNYLN (SEQ ID NO: 107), GASNLQN (SEQ ID NO: 108), and QQSFSTPRT (SEQ ID NO: 42).

The heavy chain CDRs of the 1456_P20 (PG20) antibody have the following sequences per Chothia definition: GGTFSS (SEQ ID NO: 268), MVTPIFGEAK (SEQ ID NO: 269), and DRRAVPIATDNWLDP (SEQ ID NO: 9). The light chain CDRs of the 1456_P20 (PG20) antibody have the following sequences per Chothia definition: RASQTINNYLN (SEQ ID NO: 107), GASNLQN (SEQ ID NO: 108), and QQSFSTPRT (SEQ ID NO: 42).

The 1460_G14 (PGG14) antibody includes a heavy chain variable region (SEQ ID NO: 35), encoded by the nucleic acid sequence shown in SEQ ID NO: 109, and a light chain variable region (SEQ ID NO: 36) encoded by the nucleic acid sequence shown in SEQ ID NO: 112.

The heavy chain CDRs of the 1460_G14 (PGG14) antibody have the following sequences per Kabat definition: SYAFS (SEQ ID NO: 110), MITPVFGETKYAPRFQG (SEQ ID NO: 111), and DRRVVPMATDNWLDP (SEQ ID NO: 8). The light chain CDRs of the 1460_G14 (PGG14) antibody have the following sequences per Kabat definition: RASQTIHTYLN (SEQ ID NO: 113), GASTLQS (SEQ ID NO: 114), QQSYSTPRT (SEQ ID NO: 43).

The heavy chain CDRs of the 1460_G14 (PGG14) antibody have the following sequences per Chothia definition: GGAFSS (SEQ ID NO: 270), MITPVFGETK (SEQ ID NO: 271), DRRVVPMATDNWLDP (SEQ ID NO: 8). The light chain CDRs of the 1460_G14 (PGG14) antibody have the following sequences per Chothia definition: RASQTIHTYLN (SEQ ID NO: 113), GASTLQS (SEQ ID NO: 114), QQSYSTPRT (SEQ ID NO: 43).

The 1495_C14 (PGC14) antibody includes a heavy chain variable region (SEQ ID NO: 37), encoded by the nucleic acid sequence shown in SEQ ID NO: 115, and a light chain variable region (SEQ ID NO: 38) encoded by the nucleic acid sequence shown in SEQ ID NO: 119.

The heavy chain CDRs of the 1495_C14 (PGC14) antibody have the following sequences per Kabat definition: DYYLH (SEQ ID NO: 116), LIDPENGEARYAEKFQG (SEQ ID NO: 117), GAVGADSGSWFDP (SEQ ID NO: 10). The light chain CDRs of the 1495_C14 (PGC14) antibody have the following sequences per Kabat definition: SGSKLGDKYVS (SEQ ID NO: 120), ENDRRPS (SEQ ID NO: 121), and QAWETTTTTFVF (SEQ ID NO: 44).

The heavy chain CDRs of the 1495_C14 (PGC14) antibody have the following sequences per Chothia definition: GYSFID (SEQ ID NO: 102), LIDPENGEAR (SEQ ID NO: 103), GAVGADSGSWFDP (SEQ ID NO: 10). The light chain CDRs of the 1495_C14 (PGC14) antibody have the following sequences per Chothia definition: SGSKLGDKYVS (SEQ ID NO: 120), ENDRRPS (SEQ ID NO: 121), and QAWETTTTTFVF (SEQ ID NO: 44).

The 1496_C09 (PG9) antibody includes a heavy chain variable region (SEQ ID NO: 39), encoded by the nucleic acid sequence shown in SEQ ID NO: 122, and a light chain variable region (SEQ ID NO: 40) encoded by the nucleic acid sequence shown in SEQ ID NO: 125.

The heavy chain CDRs of the 1496_C09 (PG9) antibody have the following sequences per Kabat definition: RQGMH (SEQ ID NO: 123), FIKYDGSEKYHADSVWG (SEQ ID NO: 124), and EAGGPDYRNGYNYYDFYDGYYNYHYMDV (SEQ ID NO: 7). The light chain CDRs of the 1496_C09 (PG9) antibody have the following sequences per Kabat definition: NGTSNDVGGYESVS (SEQ ID NO: 126), DVSKRPS (SEQ ID NO: 127), and KSLTSTRRRV (SEQ ID NO: 45).

The heavy chain CDRs of the 1496_C09 (PG9) antibody have the following sequences per Chothia definition: GFDFSR (SEQ ID NO: 118), FIKYDGSEKY (SEQ ID NO: 272), and EAGGPDYRNGYNYYDFYDGYYNYHYMDV (SEQ ID NO: 7). The light chain CDRs of the 1496_C09 (PG9) antibody have the following sequences per Chothia definition: NGTSNDVGGYESVS (SEQ ID NO: 126), DVSKRPS (SEQ ID NO: 127), and KSLTSTRRRV (SEQ ID NO: 45).

TABLE 6A

Heavy Chain Variable Region Protein Alignment

| | | | | | | | 10 | | | | | | | 20 | | | | | | 30 | | | | | | 40 | | |
|---|---|---|---|---|---|---|---|---|---|---|---|---|---|---|---|---|---|---|---|---|---|---|---|---|---|---|---|---|
| 1495_C14_G1 ref | D | G H L | V Q S G | V E | V K K T | G A T V | K I | | S C K V | S G Y S | | F I | D Y Y L | H W V Q | | R A | P G K G | | L E |
| 1460_G14_G1 ref | Q V L L | V Q S G | T E | V K K P | G S S V | K V | | S C Q A | S G G A | | F S | S Y A F | S W V R | | Q A | P G Q G | | L E |

TABLE 6A-continued

Heavy Chain Variable Region Protein Alignment

```
1456_    QVRL VQSG PE VKKP GSSV TV SCQA SGGT FS SYAF TWVR QA PGQG LE
P20_
G1 ref 1443_    QEQL VESG GG VVQP GGSL RL SCLA SGFT FH KYGM HWVR QA PGKG LE
C16_
G3 ref 1496_    Q-RL VESG GG VVQP GSSL RL SCAA SGFD FS RQGM HWVR QA PGQG LE
C09_
G3 ref
```

```
              50           60           70           80           90

1495_    WVGL IDPE NG EARY AEKF QG RVTI IADT SI DTGY MEMR SL KSED TA
C14_
G1 ref 1460_    WMGM ITPV FG ETKY APRF QG RLTL TAEE SL STTY MELR SL TSDD TA
G14_
G1 ref 1456_    WLGM VTPI FG EAKY SQRF EG RVTI TADE ST STTS IELR GL TSED TA
P20_
G1 ref 1443_    WVAL ISDD GM RKYH SDSM WG RVTI SRDN SK NTLY LQFS SL KVED TA
C16_
G3 ref 1496_    WVAF IKYD GS EKYH ADSV WG RLSI SRDN SK DTLY LQMN SL RVED TA
C09_
G3 ref
```

```
                  100          110          120          130

1495_    VYFC AAG- -- ---- ---- -- --AV GADS GS WFDP WGQG TL VTVS S
C14_
G1 ref

1460_    FYYC TRDR R- ---- ---- -- --VV PMAT DN WLDP WGQG TL VTVS S
G14_
G1 ref

1456_    IYYC ARDR R- ---- ---- -- --AV PIAT DN WLDP WGQG TL VTVS S
P20_
G1 ref

1443_    MFFC AREA GG PIWH DDVK YY DFND GYYN YH YMDV WGKG TT VTVS S
C16_
G3 ref

1496_    TYFC VREA GG PDYR NGYN YY DFYD GYYN YH YMDV WGKG TT VTVS S
C09_
G3 ref
```

TABLE 6B

Light Chain Variable Region Protein Alignment

```
                         10           20           30

1495_C14_L3 ref S Y EL TQ-PPS VS VS PGQTAS IT CS GSK--- LG DK YVSW

1460_G14_K1 ref D I QL TQSPSS LS AS VGDRVT VT CR ASQT-- -I HT YLNW

1456_P20_K1 ref D I QL TQSPSS LS AS VGDRVS IT CR ASQT-- -I NN YLNW

1443_C16_L2 ref Q S AL TQ-PAS VS GS PGQTIT IS CN GTSSDV GG FD SVSW

1496_C09_L2 ref Q S AL TQ-PAS VS GS PGQSIT IS CN GTSNDV GG YE SVSW
```

TABLE 6B-continued

Light Chain Variable Region Protein Alignment

|  | 40 | | | | | | 50 | | | | | 60 | | | | 70 | | | |
|---|---|---|---|---|---|---|---|---|---|---|---|---|---|---|---|---|---|---|---|
| 1495_C14_L3 ref | Y Q | L R | P G Q S P I | L V | M Y | E N D R R P | S G | I P | E R F S G S | N S | G D | T A T L |
| 1460_G14_K1 ref | Y Q | Q I | P G K A P K | L L | I Y | G A S T L Q | S G | V P | S R F S G S | G S | G T | D F T L |
| 1456_P20_K1 ref | Y Q | Q T | P G K A P K | L L | I Y | G A S N L Q | N G | V P | S R F S G S | G S | G T | D F T L |
| 1443_C16_L2 ref | Y Q | Q S | P G K A P K | V M | V F | D V S H R P | S G | I S | N R F S G S | K S | G N | T A S L |
| 1496_C09_L2 ref | Y Q | Q H | P G K A P K | V V | I Y | D V S K R P | S G | V S | N R F S G S | K S | G N | T A S L |

|  | 80 | | | | 90 | | | | 100 | | | | 110 | | | |
|---|---|---|---|---|---|---|---|---|---|---|---|---|---|---|---|---|
| 1495_C14_L3 ref | T I | S G | T Q A L D E | A D | F Y | C Q A W E T | T T | T T | F V F F G G | G T | Q L | T V L G |
| 1460_G14_K1 ref | T I | N S | L Q P E D F | A T | Y Y | C Q Q - - - | S Y | S T | P R T F G Q | G T | R L | D I K - |
| 1456_P20_K1 ref | T I | S S | L Q P E D F | A T | Y Y | C Q Q - - - | S F | S T | P R T F G Q | G T | R L | D I K - |
| 1443_C16_L2 ref | T I | S G | L H I E D E | G D | Y F | C S S - - L | T D | R S | H R I F G G | G T | K V | T V L G |
| 1496_C09_L2 ref | T I | S G | L Q A E D E | G D | Y Y | C K S - - L | T S | T R | R R V F G T | G T | K L | T V L G |

The sequences of sister clones to human monoclonal antibody 1443_C16 (PG16) were determined, including the sequences of the variable regions of the Gamma heavy and Kappa or Lambda light chains. In addition, the sequence of each of the polynucleotides encoding the antibody sequences was determined. Shown below are the polypeptide and polynucleotide sequences of the gamma heavy chains and kappa light chains, with the signal peptides at the N-terminus (or 5' end) and the constant regions at the C-terminus (or 3' end) of the variable regions, which are shown in bolded text.

1469_M23 (PG16) (TCN-118) gamma heavy chain nucleotide sequence: 1469_M23 γ3 coding sequence (variable region in bold)

(SEQ ID NO: 138)
ATGGAGTTTGGGCTGAGCTGGGTTTTCCTCGCAACTCTGTTAAGAGTTG

TGAAGTGTCAGGAAAAACTGGTGGAGTCTGGGGGAGGCGTGGTCC

AGCCGGGGGGGTCCCTGAGACTCTCCTGTTTAGCGTCTGGATTCA

CCTTTCACAAATATGGCATGCACTGGGTCCGCCAGGCTCCAGGCA

AGGGCCTGGAGTGGGTGGCACTCATCTCAGATGACGGAATGAGGA

AATATCATTCAGACTCCATGTGGGGCCGAGTCACCATCTCCAGAG

ACAATTCCAAGAACACTCTATATCTGCAATTCaGCAGCCTGAAAGT

CGAAGACACGGCTATGTTCTTCTGTGCGAGAGAGGCTGGTGGGCC

AATCTGGCATGACGACGTCAAATATTACGATTTTAATGACGGCTAC

TACAACTACCACTACATGGACGTCTGGGGCAAGGGGACCACGGTC

ACCGtCTCCTCAGCGTCGACCAAGGGCCCATCGGTCTTCCCCTCTGGCA

CCATCATCCAAGTCGACCTCTGGGGGCACAGCGGCCCTGGGCTGCCTG

GTCAAGGACTACTTCCCCGAACCGGTGACGGTGTCGTGGAACTCAGGC

GCCCTGACCAGCGGCGTGCACACCTTCCCGGCTGTCCTACAGTCCTCA

GGACTCTACTCCCTCAGCAGCGTGGTGACCGTGCCCTCCAGCAGCTTG

GGCACCCAGACCTACATCTGCAACGTGAATCACAAGCCCAGCAACACC

AAGGTGGACAAGAGAGTTGAGCCCAAATCTTGTGACAAAACTCACAC

ATGCCCACCGTGCCCAGCACCTGAACTCCTGGGGGGACCGTCAGTCTT

CCTCTTCCCCCCAAAACCCAAGGACACCCTCATGATCTCCCGGACCCC

TGAGGTCACATGCGTGGTGGTGGACGTGAGCCACGAAGACCCTGAGGT

CAAGTTCAACTGGTACGTGGACGGCGTGGAGGTGCATAATGCCAAGAC

AAAGCCGCGGGAGGAGCAGTACAACAGCACGTACCGTGTGGTCAGCG

TCCTCACCGTCCTGCACCAGGACTGGCTGAATGGCAAGGAGTACAAGT

GCAAGGTCTCCAACAAAGCCCTCCCAGCCCCCATCGAGAAAACCATCT

CCAAAGCCAAAGGGCAGCCCCGAGAACCACAGGTGTACACCCTGCCC

CCATCCCGGGAGGAGATGACCAAGAACCAGGTCAGCCTGACCTGCCT

GGTCAAAGGCTTCTATCCCAGCGACATCGCCGTGGAGTGGGAGAGCAA

TGGGCAGCCGGAGAACAACTACAAGACCACGCCTCCCGTGCTGGACTC

CGACGGCTCCTTCTTCCTCTATAGCAAGCTCACCGTGGACAAGAGCAG

GTGGCAGCAGGGGAACGTCTTCTCATGCTCCGTGATGCATGAGGCTCT

GCACAACCACTACACGCAGAAGAGCCTCTCCCTGTCTCCGGGTAAATG

A

1469_M23 (PG16) (TCN-118) gamma heavy chain variable region nucleotide sequence:

(SEQ ID NO: 128)
CAGGAAAAACTGGTGGAGTCTGGGGGAGGCGTGGTCCAGCCGGGGGG

GTCCCTGAGACTCTCCTGTTTAGCGTCTGGATTCACCTTTCACAAATAT

GGCATGCACTGGGTCCGCCAGGCTCCAGGCAAGGGCCTGGAGTGGGT

GGCACTCATCTCAGATGACGGAATGAGGAAATATCATTCAGACTCCAT

GTGGGGCCGAGTCACCATCTCCAGAGACAATTCCAAGAACACTCTATA

TCTGCAATTCaGCAGCCTGAAAGTCGAAGACACGGCTATGTTCTTCTGT

```
GCGAGAGAGGCTGGTGGGCCAATCTGGCATGACGACGTCAAATATTAC

GATTTTAATGACGGCTACTACAACTACCACTACATGGACGTCTGGGGC

AAGGGGACCACGGTCACCGtCTCCTCA
```

1469_M23 (PG16) (TCN-118) gamma heavy chain amino acid sequence: expressed protein with variable region in bold.

(SEQ ID NO: 139)
QEKLVESGGGVVQPGGSLRLSCLASGFTFHKYGMHWVRQAPGKGLE

WVALISDDGMRKYHSDSMWGRVTISRDNSKNTLYLQFSSLKVEDTA

MFFCAREAGGPIWHDDVKYYDFNDGYYNYHYMDVWGKGTTVTVSS

ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK

1469_M23 (PG16) (TCN-118) gamma heavy chain variable region amino acid sequence: (Kabat CDRs underlined, Chothia CDRs in bold italics)

(SEQ ID NO: 140)
QEKLVESGGGVVQPGGSLRLSCLAS*GFTFHK*YGMHWVRQAPGK

GLEWVA*L ISDDGMRKYR*VTISRDNSKNTLYLQFSSLKVEDTAMFFCA

REAG *NGTSNDVGGYESVS*WGKGTTVTVSS

1469_M23 (PG16) (TCN-118) gamma heavy chain Kabat CDRs:

```
                                          (SEQ ID NO: 88)
    CDR 1: KYGMH (SEQ ID NO: 89)
    CDR 2: LISDDGMRKYHSDSMWG (SEQ ID NO: 6)
    CDR 3: EAGGPIWHDDVKYYDFNDGYYNYHYMDV
```

1469_M23 (PG16) (TCN-118) gamma heavy chain Chothia CDRs:

```
                                          (SEQ ID NO: 266)
    CDR 1: GFTFHK (SEQ ID NO: 267)
    CDR 2: LISDDGMRKY (SEQ ID NO: 6)
    CDR 3: EAGGPIWHDDVKYYDFNDGYYNYHYMDV
```

1469_M23 (PG16) (TCN-118) lambda light chain nucleotide sequence: 1469_M23 ?2 coding sequence (variable region in bold)

(SEQ ID NO: 141)
```
ATGGCCTGGGCTCTGCTATTCCTCACCCTCTTCACTCAGGGCACAGGGT

CCTGGGGCCAGTCTGCCCTGACTCAGCCTGCCTCCGTGTCTGGGTC

TCCTGGACAGACGATCACCATCTCCTGCAATGGAACCAGAAGTGA

CGTTGGTGGATTTGACTCTGTCTCCTGGTACCAACAATCCCCAGG

GAGAGCCCCCAAAGTCATGGTTTTTGATGTCAGTCATCGGCCCTC

AGGTATCTCTAATCGCTTCTCTGGCTCCAAGTCCGGCAACACGGC

CTCCCTGACCATCTCTGGGCTCCACATTGAGGACGAGGGCGATTA

TTTCTGCTCTTCACTGACAGACAGAAGCCATCGCATATTCGGCGG

CGGGACCAAGCTGACCGTTCTAGGTCAGCCCAAGGCTGCCCCCTCG

GTCACTCTGTTCCCGCCCTCCTCTGAGGAGCTTCAAGCCAACAAGGCC

ACACTGGTGTGTCTCATAAGTGACTTCTACCCGGGAGCCGTGACAGTG

GCCTGGAAGGCAGATAGCAGCCCCGTCAAGGCGGGAGTGGAGACCAC

CACACCCTCCAAACAAAGCAACAACAAGTACGCGGCCAGCAGCTACC

TGAGCCTGACGCCTGAGCAGTGGAAGTCCCACAAAAGCTACAGCTGCC

AGGTCACGCATGAAGGGAGCACCGTGGAGAAGACAGTGGCCCCCTACA

GAATGTTCATAG
```

1469_M23 (PG16) (TCN-118) lambda light chain variable region nucleotide sequence:

(SEQ ID NO: 129)
```
CAGTCTGCCCTGACTCAGCCTGCCTCCGTGTCTGGGTCTCCTGGACAGA

CGATCACCATCTCCTGCAATGGAACCAGAAGTGACGTTGGTGGATTTG

ACTCTGTCTCCTGGTACCAACAATCCCCAGGGAGAGCCCCCAAAGTCA

TGGTTTTTGATGTCAGTCATCGGCCCTCAGGTATCTCTAATCGCTTCTC

TGGCTCCAAGTCCGGCAACACGGCCTCCCTGACCATCTCTGGGCTCCA

CATTGAGGACGAGGGCGATTATTTCTGCTCTTCACTGACAGACAGAAG

CCATCGCATATTCGGCGGCGGGACCAAGCTGACCGTTCTA
```

1469_M23 (PG16) (TCN-118) lambda light chain amino acid sequence: expressed protein with variable region in bold.

(SEQ ID NO: 142)
QSALTQPASVSGSPGQTITISCNGTRSDVGGFDSVSWYQQSPGRAPKV

MVFDVSHRPSGISNRFSGSKSGNTASLTISGLHIEDEGDYFCSSLTDRS

HRIFGGGTKLTVLGQPKAAPSVTLFPPSSEELQANKATLVCLISDFYPGA

VTVAWKADSSPVKAGVETTTPSKQSNNKYAASSYLSLTPEQWKSHKSYS

CQVTHEGSTVEKTVAPTECS

1469_M23 (PG16) (TCN-118) lambda light chain variable region amino acid sequence: (Kabat CDRs underlined, Chothia CDRs in bold italics)

(SEQ ID NO: 96)
QSALTQPASVSGSPGQTITISC*__NGTRSDVGGFDSVS__*WYQQSPGRAPK

VMVED *__VSHRPS__*GISNRFSGSKSGNTASLTISGLHIEDEGDYFC

*__SSLTDRSHRI__*FGGGTKLTVL

1469_M23 (PG16) (TCN-118) lambda light chain Kabat CDRs:

```
                                    (SEQ ID NO: 92)
        CDR 1: NGTRSDVGGFDSVS (SEQ ID NO: 95)
        CDR 2: DVSHRPS (SEQ ID NO: 41)
        CDR 3: SSLTDRSHRI
```

1469_M23(PG16) (TCN-118) lambda light chain Chothia CDRs:

```
                                    (SEQ ID NO: 92)
        CDR 1: NGTRSDVGGFDSVS (SEQ ID NO: 95)
        CDR 2: DVSHRPS (SEQ ID NO: 41)
        CDR 3: SSLTDRSHRI
```

1456_A12 (PG16) (TCN-117) gamma heavy chain nucleotide sequence: 1456_A12 γ3 coding sequence (variable region in bold)

```
                                                  (SEQ ID NO: 46)
ATGGAGTTTGGGCTGAGCTGGGTTTTCCTCGCAACTCTGTTAAGAGTTG

TGAAGTGT**CACGAACAACTGGTGGAGGCCGGGGGAGGCGTGGTCC

AGCCGGGGGGGTCCCTGAGACTCTCCTGTTTAGCGTCTGGATTCA

CGTTTCACAAATATGGCATGCACTGGGTCCGCCAGGCTCCAGGCA

AGGGCCTGGAGTGGGTGGCACTCATCTCAGATGACGGAATGAGGA

AATATCATTCAGACTCCATGTGGGCCGAGTCACCATCTCCAGAG

ACAATTCCAAGAACACTCTTTATCTGCAATTCAGCAGCCTGAGAGT

CGAAGACACGGCTATGTTCTTCTGTGCGAGAGAGGCCGGTGGGCC

AATCTGGCATGACGACGTCAAATATTACGATTTTAATGACGGCTAC

TACAACTATCACTACATGGACGTCTGGGGCAAGGGGACCAAGGTC**

ACCGTCTCCTCAGCGTCGACCAAGGGCCCATCGGTCTTCCCTCTGGCA

CCATCATCCAAGTCGACCTCTGGGGGCACAGCGGCCCTGGGCTGCCTG

GTCAAGGACTACTTCCCCGAACCGGTGACGGTGTCGTGGAACTCAGGC

GCCCTGACCAGCGGCGTGCACACCTTCCCGGCTGTCCTACAGTCCTCA

GGACTCTACTCCCTCAGCAGCGTGGTGACCGTGCCCTCCAGCAGCTTG

GGCACCCAGACCTACATCTGCAACGTGAATCACAAGCCCAGCAACACC

AAGGTGGACAAGAGAGTTGAGCCCAAATCTTGTGACAAAACTCACAC

ATGCCCACCGTGCCCAGCACCTGAACTCCTGGGGGGACCGTCAGTCTT

CCTCTTCCCCCCAAAACCCAAGGACACCCTCATGATCTCCCGGACCCC

TGAGGTCACATGCGTGGTGGTGGACGTGAGCCACGAAGACCCTGAGGT
```

CAAGTTCAACTGGTACGTGGACGGCGTGGAGGTGCATAATGCCAAGAC

AAAGCCGCGGGAGGAGCAGTACAACAGCACGTACCGTGTGGTCAGCG

TCCTCACCGTCCTGCACCAGGACTGGCTGAATGGCAAGGAGTACAAGT

GCAAGGTCTCCAACAAAGCCCTCCCAGCCCCCATCGAGAAAACCATCT

CCAAAGCCAAAGGGCAGCCCCGAGAACCACAGGTGTACACCCTGCCC

CCATCCCGGGAGGAGATGACCAAGAACCAGGTCAGCCTGACCTGCCT

GGTCAAAGGCTTCTATCCCAGCGACATCGCCGTGGAGTGGGAGAGCAA

TGGGCAGCCGGAGAACAACTACAAGACCACGCCTCCCGTGCTGGACTC

CGACGGCTCCTTCTTCCTCTATAGCAAGCTCACCGTGGACAAGAGCAG

GTGGCAGCAGGGGAACGTCTTCTCATGCTCCGTGATGCATGAGGCTCT

GCACAACCACTACACGCAGAAGAGCCTCTCCCTGTCTCCGGGTAAATG

A

1456_A12 (PG16) (TCN-117) gamma heavy chain variable region nucleotide sequence:

```
                                                  (SEQ ID NO: 130)
CACGAACAACTGGTGGAGGCCGGGGGAGGCGTGGTCCAGCCGGGGGG

GTCCCTGAGACTCTCCTGTTTAGCGTCTGGATTCACGTTTCACAAATAT

GGCATGCACTGGGTCCGCCAGGCTCCAGGCAAGGGCCTGGAGTGGGT

GGCACTCATCTCAGATGACGGAATGAGGAAATATCATTCAGACTCCAT

GTGGGGCCGAGTCACCATCTCCAGAGACAATTCCAAGAACACTCTTTA

TCTGCAATTCAGCAGCCTGAGAGTCGAAGACACGGCTATGTTCTTCTG

TGCGAGAGAGGCCGGTGGGCCAATCTGGCATGACGACGTCAAATATTA

CGATTTTAATGACGGCTACTACAACTATCACTACATGGACGTCTGGGG

CAAGGGGACCAAGGTCACCGTCTCCTCA
```

1456_A12 (PG16) (TCN-117) gamma heavy chain amino acid sequence: expressed protein with variable region in bold.

```
                                                  (SEQ ID NO: 47)
**HEQLVEAGGGVVQPGGSLRLSCLASGFTFHKYGMHWVRQAPGKGL

EWVALISDDGMRKYHSDSMWGRVTISRDNSKNTLYLQFSSLRVEDTA

MFFCAREAGGPIWHDDVKYYDFNDGYYNYHYMDVWGKGTKVTVSS**

ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK
```

1456_A12 (PG16) (TCN-117) gamma heavy chain variable region amino acid sequence: (Kabat CDRs underlined, Chothia CDRs in bold italics)

(SEQ ID NO: 48)
HEQLVEAGGGVVQPGGSLRLSCLAS*GFTFHK*YGMHWVRQAPGKGLEW

VA*LISDDGMRKY*HSDSMWGRVTISRDNSKNTLYLQFSSLRVEDTAMF

FCAR*EAGGPIQHDDVKYYDFNDGYYNYHYMDV*WGKGTKVTVSS

1456_A12 (PG16) (TCN-117) gamma heavy chain Kabat CDRs:

```
                                   (SEQ ID NO: 88)
        CDR 1: KYGMH (SEQ ID NO: 89)
        CDR 2: LISDDGMRKYHSDSMWG (SEQ ID NO: 6)
        CDR 3: EAGGPIWHDDVKYYDFNDGYYNYHYMDV
```

1456_A12 (PG16) (TCN-117) gamma heavy chain Chothia CDRs:

```
                                   (SEQ ID NO: 266)
        CDR 1: GFTFHK (SEQ ID NO: 267)
        CDR 2: LISDDGMRKY (SEQ ID NO: 6)
        CDR 3: EAGGPIWHDDVKYYDFNDGYYNYHYMDV
```

1456_A12 (PG16) (TCN-117) lambda light chain nucleotide sequence: 1456_A12 λ2 coding sequence (variable region in bold)

```
                                   (SEQ ID NO: 49)
ATGGCCTGGGCTTGCTATTCCTCACCCTCTTCACTCAGGGCACAGGGTC
CTGGGGCCAGTCTGCCCTGACTCAGCCTGCCTCCGTGTCTGGGTCT
CCTGGACAGACGATCACCATCTCCTGCAATGGAACCAGCCGTGAC
GTTGGTGGATTTGACTCTGTCTCCTGGTATCAACAATCCCCAGGG
AAAGCCCCCAAAGTCATGGTTTTTGATGTCAGTCATCGGCCCTCA
GGTATGTCTAATCGCTTCTCTGGCTCCAAGTCCGGCAACACGGCC
TCCCTGACCATTTCTGGGCTCCACATTGAGGACGAGGGCGATTAT
TTCTGCTCTTCATTGACAGACAGAAGCCATCGCATATTCGGCGGC
GGGACCAAGCTGACCGTTCTAGGTCAGCCCAAGGCTGCCCCCTCGGT
CACTCTGTTCCCGCCCTCCTCTGAGGAGCTTCAAGCCAACAAGGCCAC
ACTGGTGTGTCTCATAAGTGACTTCTACCCGGGAGCCGTGACAGTGGC
CTGGAAGGCAGATAGCAGCCCCGTCAAGGCGGGAGTGGAGACCACCA
CACCCTCCAAACAAAGCAACAACAAGTACGCGGCCAGCAGCTACCTG
AGCCTGACGCCTGAGCAGTGGAAGTCCCACAAAAGCTACAGCTGCCA
GGTCACGCATGAAGGGAGCACCGTGGAGAAGACAGTGGCCCCTACAG
AATGTTCATAG
```

1456_A12 (PG16) (TCN-117) lambda light chain variable region nucleotide sequence:

```
                                   (SEQ ID NO: 131)
CAGTCTGCCCTGACTCAGCCTGCCTCCGTGTCTGGGTCTCCTGGACAGA
CGATCACCATCTCCTGCAATGGAACCAGCCGTGACGTTGGTGGATTTG
ACTCTGTCTCCTGGTATCAACAATCCCCAGGGAAAGCCCCCAAAGTCA
TGGTTTTTGATGTCAGTCATCGGCCCTCAGGTATGTCTAATCGCTTCTC
TGGCTCCAAGTCCGGCAACACGGCCTCCCTGACCATTTCTGGGCTCCA
CATTGAGGACGAGGGCGATTATTTCTGCTCTTCATTGACAGACAGAAG
CCATCGCATATTCGGCGGCGGGACCAAGCTGACCGTTCTA
```

1456_A12 (PG16) (TCN-117) lambda light chain amino acid sequence: expressed protein with variable region in bold.

```
                                   (SEQ ID NO: 50)
QSALTQPASVSGSPGQTITISCNGTSRDVGGFDSVSWYQQSPGKAPKV
MVFDVSHRPSGMSNRFSGSKSGNTASLTISGLHIEDEGDYFCSSLTDRS
HRIFGGGTKLTVLGQPKAAPSVTLFPPSSEELQANKATLVCLISDFYPGA
VTVAWKADSSPVKAGVETTTPSKQSNNKYAASSYLSLTPEQWKSHKSYS
CQVTHEGSTVEKTVAPTECS
```

1456_A12 (PG16) (TCN-117) lambda light chain variable region amino acid sequence: (Kabat CDRs underlined, Chothia CDRs in bold italics)

```
                                   (SEQ ID NO: 51)
QSALTQPASVSGSPGQTITISC***NGTSRDVGGFDSVS***WYQQSPGKAPK
VMVF*D**VSHRPS*GMSNRFSGSKSGNTASLTISGLHIEDEGDYFC
SSLTDRSHRIFGGGTKLTVL
```

1456 A12 (PG16) (TCN-117) lambda light chain Kabat CDRs:

```
                                   (SEQ ID NO: 93)
        CDR 1: NGTSRDVGGFDSVS (SEQ ID NO: 95)
        CDR 2: DVSHRPS (SEQ ID NO: 41)
        CDR 3: SSLTDRSHRI
```

1456_A12 (PG16) (TCN-117) lambda light chain Chothia CDRs:

```
                                   (SEQ ID NO: 93)
        CDR 1: NGTSRDVGGFDSVS (SEQ ID NO: 95)
        CDR 2: DVSHRPS (SEQ ID NO: 41)
        CDR 3: SSLTDRSHRI
```

1503_H05 (PG16) (TCN-119) gamma heavy chain nucleotide sequence: 1503_H05 γ3 coding sequence (variable region in bold)

```
                                   (SEQ ID NO: 52)
ATGGAGTTTGGCTGAGCTGGGTTTTCCTCGCAACTCTGTTAAGAGTTGT
GAAGTGTCAGGAAAAACTGGTGGAGTCTGGGGGAGGCGTGGTCCA
```

```
GCCGGGGGGTCCCTGAGACTCTCCTGTTTAGCGTCTGGATTCAC

CTTTCACAAATATGGCATGCACTGGGTCCGCCAGGCTCCAGGCAA

GGGCCTGGAGTGGGTGGCACTCATCTCAGATGACGGAATGAGGAA

ATATCATTCAGACTCCATGTGGGGCCGAGTCACCATCTCCAGAGA

CAATTCCAAGAACACTTTATATCTGCAATTCAGCAGCCTGAAAGTC

GAAGACACGGCTATGTTCTTCTGTGCGAGAGAGGCTGGTGGGCCA

ATCTGGCATGACGACGTCAAATATTACGATTTTAATGACGGCTACT

ACAATTACCACTACATGGACGTCTGGGGCAAGGGGACCATTGTCA

CCGTCTCCTCAGCGTCGACCAAGGGCCCATCGGTCTTCCCTCTGGCAC

CATCATCCAAGTCGACCTCTGGGGGCACAGCGGCCCTGGGCTGCCTGG

TCAAGGACTACTTCCCCGAACCGGTGACGGTGTCGTGGAACTCAGGCG

CCCTGACCAGCGGCGTGCACACCTTCCCGGCTGTCCTACAGTCCTCAG

GACTCTACTCCCTCAGCAGCGTGGTGACCGTGCCCTCCAGCAGCTTGG

GCACCCAGACCTACATCTGCAACGTGAATCACAAGCCCAGCAACACCA

AGGTGGACAAGAGAGTTGAGCCCAAATCTTGTGACAAAACTCACACAT

GCCCACCGTGCCCAGCACCTGAACTCCTGGGGGGACCGTCAGTCTTCC

TCTTCCCCCCAAAACCCAAGGACACCCTCATGATCTCCCGGACCCCTG

AGGTCACATGCGTGGTGGTGGACGTGAGCCACGAAGACCCTGAGGTC

AAGTTCAACTGGTACGTGGACGGCGTGGAGGTGCATAATGCCAAGAC

AAAGCCGCGGGAGGAGCAGTACAACAGCACGTACCGTGTGGTCAGCG

TCCTCACCGTCCTGCACCAGGACTGGCTGAATGGCAAGGAGTACAAGT

GCAAGGTCTCCAACAAAGCCCTCCCAGCCCCCATCGAGAAAACCATCT

CCAAAGCCAAAGGGCAGCCCCGAGAACCACAGGTGTACACCCTGCCC

CCATCCCGGGAGGAGATGACCAAGAACCAGGTCAGCCTGACCTGCCT

GGTCAAAGGCTTCTATCCCAGCGACATCGCCGTGGAGTGGGAGAGCAA

TGGGCAGCCGGAGAACAACTACAAGACCACGCCTCCCGTGCTGGACTC

CGACGGCTCCTTCTTCCTCTATAGCAAGCTCACCGTGGACAAGAGCAG

GTGGCAGCAGGGGAACGTCTTCTCATGCTCCGTGATGCATGAGGCTCT

GCACAACCACTACACGCAGAAGAGCCTCTCCCTGTCTCCGGGTAAATG

A
```

1503_H05 (PG16) (TCN-119) gamma heavy chain variable region nucleotide sequence:

(SEQ ID NO: 132)
```
CAGGAAAAACTGGTGGAGTCTGGGGGAGGCGTGGTCCAGCCGGGGGG

GTCCCTGAGACTCTCCTGTTTAGCGTCTGGATTCACCTTTCACAAATAT

GGCATGCACTGGGTCCGCCAGGCTCCAGGCAAGGGCCTGGAGTGGGT

GGCACTCATCTCAGATGACGGAATGAGGAAATATCATTCAGACTCCAT

GTGGGGCCGAGTCACCATCTCCAGAGACAATTCCAAGAACACTTTATA

TCTGCAATTCAGCAGCCTGAAAGTCGAAGACACGGCTATGTTCTTCTG

TGCGAGAGAGGCTGGTGGGCCAATCTGGCATGACGACGTCAAATATTA

CGATTTTAATGACGGCTACTACAATTACCACTACATGGACGTCTGGGG

CAAGGGGACCATTGTCACCGTCTCCTCA
```

1503_H05 (PG16) (TCN-119) gamma heavy chain amino acid sequence: expressed protein with variable region in bold.

(SEQ ID NO: 53)
QEKLVESGGGVVQPGGSLRLSCLASGFTFHKYGMHWVRQAPGKGLE

WVALISDDGMRKYHSDSMWGRVTISRDNSKNTLYLQFSSLKVEDTA

MFFCAREAGGPIWHDDVKYYDFNDGYYNYHYMDVWGKGTIVTVSSASTKGPSVFPLAPSSKSTSGGTAALGCLVKDYFPEPVTVSWNSGALTSGVH

TFPAVLQSSGLYSLSSVVTVPSSSLGTQTYICNVNHKPSNTKVDKRVEPKS

CDKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKE

YKCKVSNKALPAPIEKTISKAKGQPREPQVYTLPPSREEMTKNQVSLTCLV

KGFYPSDIAVEWESNGQPENNYKTTPPVLDSDGSFFLYSKLTVDKSRWQQ

GNVFSCSVMHEALHNHYTQKSLSLSPGK.

1503_H05 (PG16) (TCN-119) gamma heavy chain variable region amino acid sequence: (Kabat CDRs underlined, Chothia CDRs in bold italics)

(SEQ ID NO: 54)
QEKLVESGGGVVQPGGSLRLSCLAS*GFTFHK*YGMHWVRQAPGKGLEW

VAL *ISDDGMRKY*HSDSMWGRVTISRDNSKNTLYLQFSSLKVEDTAMF

FCAR *EAGGPIWHDDVKYYDFNDGYYNYHYMDV*WGKGTIVTVSS

1503_H05 (PG16) (TCN-119) gamma heavy chain Kabat CDRs:

(SEQ ID NO: 88)
CDR 1: KYGMH (SEQ ID NO: 89)
CDR 2: LISDDGMRKYHSDSMWG (SEQ ID NO: 6)
CDR 3: EAGGPIWHDDVKYYDFNDGYYNYHYMDV

1503_H05 (PG16) (TCN-119) gamma heavy chain Chothia CDRs:

(SEQ ID NO: 266)
CDR 1: GFTFHK (SEQ ID NO: 267)
CDR 2: LISDDGMRKY (SEQ ID NO: 6)
CDR 3: EAGGPIWHDDVKYYDFNDGYYNYHYMDV

1503_H05 (PG16) (TCN-119) lambda light chain nucleotide sequence: 1503_H05 A2 coding sequence (variable region in bold)

(SEQ ID NO: 55)
ATGGCCTGGGCTTGCTATTCCTCACCCTCTTCACTCAGGGCACAGGGTC

CTGGGGCCAGTCTGCCCTGACTCAGCCTGCCTCCGTGTCTGGGTCT

-continued

CCTGGACAGACGATCACCATCTCCTGCAATGGAACCAGAAGTGAC

GTTGGTGGATTTGACTCTGTCTCCTGGTACCAACAATCCCCAGGG

AAAGCCCCCAAAGTCATGGTTTTTGATGTCAGTCATCGGCCCTCA

GGTATCTCTAATCGCTTCTCTGGCTCCAAGTCCGGCAACACGGCC

TCCCTGACCATCTCTGGGCTCCACATTGAGGACGAGGGCGATTAT

TTCTGCTCTTCACTGACAGACAGAAGCCATCGCATATTCGGCGGC

GGGACCAAGGTGACCGTTCTAGGTCAGCCCAAGGCTGCCCCTCGGT

CACTCTGTTCCCGCCCTCCTCTGAGGAGCTTCAAGCCAACAAGGCCAC

ACTGGTGTGTCTCATAAGTGACTTCTACCCGGGAGCCGTGACAGTGGC

CTGGAAGGCAGATAGCAGCCCCGTCAAGGCGGGAGTGGAGACCACCA

CACCCTCCAAACAAAGCAACAACAAGTACGCGGCCAGCAGCTACCTG

AGCCTGACGCCTGAGCAGTGGAAGTCCCACAAAAGCTACAGCTGCCA

GGTCACGCATGAAGGGAGCACCGTGGAAGACAGTGGCCCCTACAG

AATGTTCATAG

1503_H05 (PG16) (TCN-119) lambda light chain variable region nucleotide sequence:

(SEQ ID NO: 133)
CAGTCTGCCCTGACTCAGCCTGCCTCCGTGTCTGGGTCTCCTGGACAGA

CGATCACCATCTCCTGCAATGGAACCAGAAGTGACGTTGGTGGATTTG

ACTCTGTCTCCTGGTACCAACAATCCCCAGGGAAAGCCCCCAAAGTCA

TGGTTTTTGATGTCAGTCATCGGCCCTCAGGTATCTCTAATCGCTTCTC

TGGCTCCAAGTCCGGCAACACGGCCTCCCTGACCATCTCTGGGCTCCA

CATTGAGGACGAGGGCGATTATTTCTGCTCTTCACTGACAGACAGAAG

CCATCGCATATTCGGCGGCGGGACCAAGGTGACCGTTCTA

1503_H05 (PG16) (TCN-119) lambda light chain amino acid sequence: expressed protein with variable region in bold.

(SEQ ID NO: 56)
QSALTQPASVSGSPGQTITISCNGTRSDVGGFDSVSWYQQSPGKAPKV

MVFDVSHRPSGISNRFSGSKSGNTASLTISGLHIEDEGDYFCSSLTDRS

HRIFGGGTKVTVLGQPKAAPSVTLFPPSSEELQANKATLVCLISDFYPGA

VTVAWKADSSPVKAGVETTTPSKQSNNKYAASSYLSLTPEQWKSHKSYS

CQVTHEGSTVEKTVAPTECS

1503_H05 (PG16) (TCN-119) lambda light chain variable region amino acid sequence: (Kabat CDRs underlined, Chothia CDRs in bold italics)

(SEQ ID NO: 57)
QSALTQPASVSGSPGQTITISC*NGTRSDVGGFDSVS*WYQQSPGKAPK

VMVF *DVSHRPS*GISNRFSGSKSGNTASLTISGLHIEDEGDYFC

*SSLTDRSHRI*FGGGTKVTVL

1503_H05 (PG16) (TCN-119) lambda light chain Kabat CDRs:

```
                                        (SEQ ID NO: 92)
     CDR 1: NGTRSDVGGFDSVS (SEQ ID NO: 95)
     CDR 2: DVSHRPS (SEQ ID NO: 41)
     CDR 3: SSLTDRSHRI
```

1503_H05 (PG16) (TCN-119) lambda light chain Chothia CDRs:

```
                                        (SEQ ID NO: 92)
     CDR 1: NGTRSDVGGFDSVS (SEQ ID NO: 95)
     CDR 2: DVSHRPS (SEQ ID NO: 41)
     CDR 3: SSLTDRSHRI
```

1489_I13 (PG16) (TCN-120) gamma heavy chain nucleotide sequence: 1489_I13 γ3 coding sequence (variable region in bold)

(SEQ ID NO: 58)
ATGGAGTTTGGGCTGAGCTGGGTTTTCCTCGCAACTCTGTTAAGAGTTG

TGAAGTGTCAGGAACAACTGTTGGAGTCTGGGGGAGGCGTGGTCC

AGCCGGGGGGGTCCCTGAGACTCTCCTGTTTAGCGTCTGGATTCA

CGTTTCACAAATATGGCATGCACTGGGTCCGCCAGGCTCCAGGCA

AGGGCCTGGAGTGGGTGGCACTCATCTCAGATGACGGAATGAGGA

AATATCATTCAAACTCCATGTGGGGCCGAGTCACCATCTCCAGAG

ACAATTCCAAGAACACTCTTTATCTGCAATTCAGCAGCCTGAAAGT

CGAAGACACGGCTATGTTCTTCTGTGCGAGAGAGGCTGGTGGGCC

AATCTGGCATGACGACGTCAAATATTACGATTTTAATGACGGCTAC

TACAACTACCACTACATGGACGTCTGGGGCAAGGGGACCACGGTC

ACCGTCTCCTCAGCGTCGACCAAGGGCCCATCGGTCTTCCCTCTGGCA

CCATCATCCAAGTCGACCTCTGGGGGCACAGCGGCCCTGGGCTGCCTG

GTCAAGGACTACTTCCCCGAACCGGTGACGGTGTCGTGGAACTCAGGC

GCCCTGACCAGCGGCGTGCACACCTTCCCGGCTGTCCTACAGTCCTCA

GGACTCTACTCCCTCAGCAGCGTGGTGACCGTGCCCTCCAGCAGCTTG

GGCACCCAGACCTACATCTGCAACGTGAATCACAAGCCCAGCAACACC

AAGGTGGACAAGAGAGTTGAGCCCAAATCTTGTGACAAAACTCACAC

ATGCCCACCGTGCCCAGCACCTGAACTCCTGGGGGGACCGTCAGTCTT

CCTCTTCCCCCCAAAACCCAAGGACACCCTCATGATCTCCCGGACCCC

TGAGGTCACATGCGTGGTGGTGGACGTGAGCCACGAAGACCCTGAGGT

CAAGTTCAACTGGTACGTGGACGGCGTGGAGGTGCATAATGCCAAGAC

AAAGCCGCGGGAGGAGCAGTACAACAGCACGTACCGTGTGGTCAGCG

TCCTCACCGTCCTGCACCAGGACTGGCTGAATGGCAAGGAGTACAAGT

GCAAGGTCTCCAACAAAGCCCTCCCAGCCCCCATCGAGAAAACCATCT

CCAAAGCCAAAGGGCAGCCCCGAGAACCACAGGTGTACACCCTGCCC

CCATCCCGGGAGGAGATGACCAAGAACCAGGTCAGCCTGACCTGCCT

```
GGTCAAAGGCTTCTATCCCAGCGACATCGCCGTGGAGTGGGAGAGCAA

TGGGCAGCCGGAGAACAACTACAAGACCACGCCTCCCGTGCTGGACTC

CGACGGCTCCTTCTTCCTCTATAGCAAGCTCACCGTGGACAAGAGCAG

GTGGCAGCAGGGGAACGTCTTCTCATGCTCCGTGATGCATGAGGCTCT

GCACAACCACTACACGCAGAAGAGCCTCTCCCTGTCTCCGGGTAAATG

A
```

1489_I13 (PG16) (TCN-120) gamma heavy chain variable region nucleotide sequence:

```
                                      (SEQ ID NO: 134)
CAGGAACAACTGTTGGAGTCTGGGGGAGGCGTGGTCCAGCCGGGGGG

GTCCCTGAGACTCTCCTGTTTAGCGTCTGGATTCACGTTTCACAAATAT

GGCATGCACTGGGTCCGCCAGGCTCCAGGCAAGGGCCTGGAGTGGGT

GGCACTCATCTCAGATGACGGAATGAGGAAATATCATTCAAACTCCAT

GTGGGGCCGAGTCACCATCTCCAGAGACAATTCCAAGAACACTCTTTA

TCTGCAATTCAGCAGCCTGAAAGTCGAAGACACGGCTATGTTCTTCTG

TGCGAGAGAGGCTGGTGGGCCAATCTGGCATGACGACGTCAAATATTA

CGATTTTAATGACGGCTACTACAACTACCACTACATGGACGTCTGGGG

CAAGGGGACCACGGTCACCGTCTCCTCA
```

1489_I13 (PG16) (TCN-120) gamma heavy chain amino acid sequence: expressed protein with variable region in bold.

```
                                       (SEQ ID NO: 59)
QEQLLESGGGVVQPGGSLRLSCLASGFTFHKYGMHWVRQAPGKGLE

WVALISDDGMRKYHSNSMWGRVTISRDNSKNTLYLQFSSLKVEDTA

MFFCAREAGGPIWHDDVKYYDFNDGYYNYHYMDVWGKGTTVTVSS

ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK
```

1489_I13 (PG16) (TCN-120) gamma heavy chain variable region amino acid sequence: (Kabat CDRs underlined, Chothia CDRs in bold italics)

```
                                       (SEQ ID NO: 60)
QEQLLESGGGVVQPGGSLRLSCLAS***GFTFHK***YGMHWVRQAPGKGLEW

VA***LISDDGMRKY***HSNSMWGRVTISRDNSKNTLYLQFSSLKVEDTAMF

FCAR *EAGGPIWHDDVKYYDFNDGYYNYHYMDV*WGKGTTVTVSS
```

1489_I13 (PG16) (TCN-120) gamma heavy chain Kabat CDRs:

```
                                       (SEQ ID NO: 88)
CDR 1: KYGMH (SEQ ID NO: 98)
CDR 2: LISDDGMRKYHSNSMWG (SEQ ID NO: 6)
CDR 3: EAGGPIWHDDVKYYDFNDGYYNYHYMDV
```

1489_I13 (PG16) (TCN-120) gamma heavy chain Chothia CDRs:

```
                                       (SEQ ID NO: 266)
CDR 1: GFTFHK (SEQ ID NO: 267)
CDR 2: LISDDGMRKY (SEQ ID NO: 6)
CDR 3: EAGGPIWHDDVKYYDFNDGYYNYHYMDV
```

1489_I13 (PG16) (TCN-120) lambda light chain nucleotide sequence: 1489_I13 λ2 coding sequence (variable region in bold)

```
                                       (SEQ ID NO: 61)
ATGGCCTGGGCTCTGCTATTCCTCACCCTCTTCACTCAGGGCACAGGGT

CCCGGGGCCAGTCTGCCCTGACTCAGCCTGCCTCCGTGTCTGGGTC

TCCTGGACAGACGATCACCATCTCCTGCAATGGAACCAGCAGTGA

CGTTGGTGGATTTGACTCTGTCTCCTGGTATCAACAATCCCCAGG

GAAAGCCCCCAAAGTCATGGTTTTTGATGTCAGTCATCGGCCCTC

AGGTATCTCTAATCGCTTCTCTGGCTCCAAGTCCGGCAACACGGC

CTCCCTGACCATCTCTGGGCTCCACATTGAGGACGAGGGCGATTA

TTTCTGCTCTTCACTGACAGACAGAAGCCATCGCATATTCGGCGG

CGGGACCAAGGTGACCGTTCTAGGTCAGCCCAAGGCTGCCCCCTCG

GTCACTCTGTTCCCGCCCTCCTCTGAGGAGCTTCAAGCCAACAAGGCC

ACACTGGTGTGTCTCATAAGTGACTTCTACCCGGGAGCCGTGACAGTG

GCCTGGAAGGCAGATAGCAGCCCCGTCAAGGCGGGAGTGGAGACCAC

CACACCCTCCAAACAAAGCAACAACAAGTACGCGGCCAGCAGCTACC

TGAGCCTGACGCCTGAGCAGTGGAAGTCCCACAAAAGCTACAGCTGCC

AGGTCACGCATGAAGGGAGCACCGTGGAGAAGACAGTGGCCCCTACA

GAATGTTCATAG
```

1489_I13 (PG16) (TCN-120) lambda light chain variable region nucleotide sequence:

```
                                       (SEQ ID NO: 135)
CAGTCTGCCCTGACTCAGCCTGCCTCCGTGTCTGGGTCTCCTGGACAGA

CGATCACCATCTCCTGCAATGGAACCAGCAGTGACGTTGGTGGATTTG

ACTCTGTCTCCTGGTATCAACAATCCCCAGGGAAAGCCCCCAAAGTCA

TGGTTTTTGATGTCAGTCATCGGCCCTCAGGTATCTCTAATCGCTTCTC

TGGCTCCAAGTCCGGCAACACGGCCTCCCTGACCATCTCTGGGCTCCA

CATTGAGGACGAGGGCGATTATTTCTGCTCTTCACTGACAGACAGAAG

CCATCGCATATTCGGCGGCGGGACCAAGGTGACCGTTCTA
```

1489_I13 (PG16) (TCN-120) lambda light chain amino acid sequence: expressed protein with variable region in bold.

(SEQ ID NO: 14)
QSALTQPASVSGSPGQTITISCNGTSSDVGGFDSVSWYQQSPGKAPKV

MVFDVSHRPSGISNRFSGSKSGNTASLTISGLHIEDEGDYFCSSLTDRS

HRIFGGGTKVTVLGQPKAAPSVTLFPPPSSEELQANKATLVCLISDFYPGA

VTVAWKADSSPVKAGVETTTPSKQSNNKYAASSYLSLTPEQWKSHKSYS

CQVTHEGSTVEKTVAPTECS

1489_I13 (PG16) (TCN-120) lambda light chain variable region amino acid sequence:
(Kabat CDRs underlined, Chothia CDRs in bold italics).

(SEQ ID NO: 32)
QSALTQPASVSGSPGQTITISC*NGTSSDVGGFDSVS*WYQQSPGKAPK

VMVF *DVSHRPS*GISNRFSGSKSGNTASLTISGLHIEDEGDYFC

*SSLTDRSHRI*FGGGTKVTVL

1489_I13 (PG16) (TCN-120) lambda light chain Kabat CDRs:

(SEQ ID NO: 97)
CDR 1: NGTSSDVGGFDSVS (SEQ ID NO: 95)
CDR 2: DVSHRPS (SEQ ID NO: 41)
CDR 3: SSLTDRSHRI

1489_I13 (PG16) (TCN-120) lambda light chain Chothia CDRs:

(SEQ ID NO: 97)
CDR 1: NGTSSDVGGFDSVS (SEQ ID NO: 95)
CDR 2: DVSHRPS (SEQ ID NO: 41)
CDR 3: SSLTDRSHRI

1480_I08 gamma heavy chain nucleotide sequence: 1480_I08 γ3 coding sequence (variable region in bold)

(SEQ ID NO: 64)
ATGGAGTTTGGCTGAGCTGGGTTTTCCTCGCAACTCTGTTAAGAGTTGT

GAAGTGTCAGGAACAACTGGTGGAGTCTGGGGGAGGCGTGGTCCA

GCCGGGGGGTCCCTGAGACTCTCCTGTTTAGCGTCTGGATTCAC

GTTTCACAAATATGGCATGCACTGGGTCCGCCAGGCTCCAGGCAA

GGGCCTGGAGTGGGTGGCACTCATCTCAGATGACGGAATGAGGAA

ATATCATTCAGACTCCATGTGGGGCCGAGTCACCATCTCCAGAGA

CAATTCCAAGAACACTCTTTATCTGCAATTCAGCAGCCTGAAAGTC

GAAGACACGGCTATGTTCTTCTGTGCGAGAGAGGCTGGTGGGCCA

ATCTGGCATGACGACGTCAAATATTACGATTTTAATGACGGCTACT

ACAACTACCACTACATGGACGTCTGGGGCAAGGGGACCACGGTCA

CCGTCTCCTCAGCGTCGACCAAGGGCCCATCGGTCTTCCCTCTGGCAC

CATCATCCAAGTCGACCTCTGGGGGCACAGCGGCCCTGGGCTGCCTGG

TCAAGGACTACTTCCCCGAACCGGTGACGGTGTCGTGGAACTCAGGCG

CCCTGACCAGCGGCGTGCACACCTTCCCGGCTGTCCTACAGTCCTCAG

GACTCTACTCCCTCAGCAGCGTGGTGACCGTGCCCTCCAGCAGCTTGG

GCACCCAGACCTACATCTGCAACGTGAATCACAAGCCCAGCAACACCA

AGGTGGACAAGAGAGTTGAGCCCAAATCTTGTGACAAAACTCACACAT

GCCCACCGTGCCCAGCACCTGAACTCCTGGGGGGACCGTCAGTCTTCC

TCTTCCCCCCAAAACCCAAGGACACCCTCATGATCTCCCGGACCCCTG

AGGTCACATGCGTGGTGGTGGACGTGAGCCACGAAGACCCTGAGGTC

AAGTTCAACTGGTACGTGGACGGCGTGGAGGTGCATAATGCCAAGAC

AAAGCCGCGGGAGGAGCAGTACAACAGCACGTACCGTGTGGTCAGCG

TCCTCACCGTCCTGCACCAGGACTGGCTGAATGGCAAGGAGTACAAGT

GCAAGGTCTCCAACAAAGCCCTCCCAGCCCCCATCGAGAAAACCATCT

CCAAAGCCAAAGGGCAGCCCCGAGAACCACAGGTGTACACCCTGCCC

CCATCCCGGGAGGAGATGACCAAGAACCAGGTCAGCCTGACCTGCCT

GGTCAAAGGCTTCTATCCCAGCGACATCGCCGTGGAGTGGGAGAGCAA

TGGGCAGCCGGAGAACAACTACAAGACCACGCCTCCCGTGCTGGACTC

CGACGGCTCCTTCTTCCTCTATAGCAAGCTCACCGTGGACAAGAGCAG

GTGGCAGCAGGGGAACGTCTTCTCATGCTCCGTGATGCATGAGGCTCT

GCACAACCACTACACGCAGAAGAGCCTCTCCCTGTCTCCGGGTAAATG

A

1480_I08 gamma heavy chain variable region nucleotide sequence:

(SEQ ID NO: 136)
CAGGAACAACTGGTGGAGTCTGGGGGAGGCGTGGTCCAGCCGGGGGG

GTCCCTGAGACTCTCCTGTTTAGCGTCTGGATTCACGTTTCACAAATAT

GGCATGCACTGGGTCCGCCAGGCTCCAGGCAAGGGCCTGGAGTGGGT

GGCACTCATCTCAGATGACGGAATGAGGAAATATCATTCAGACTCCAT

GTGGGGCCGAGTCACCATCTCCAGAGACAATTCCAAGAACACTCTTTA

TCTGCAATTCAGCAGCCTGAAAGTCGAAGACACGGCTATGTTCTTCTG

TGCGAGAGAGGCTGGTGGGCCAATCTGGCATGACGACGTCAAATATTA

CGATTTTAATGACGGCTACTACAACTACCACTACATGGACGTCTGGGG

CAAGGGGACCACGGTCACCGTCTCCTCA

1480_I08 gamma heavy chain amino acid sequence: expressed protein with variable region in bold.

(SEQ ID NO: 65)
QEQLVESGGGVVQPGGSLRLSCLASGFTFHKYGMHWVRQAPGKGLE

WVALISDDGMRKYHSDSMWGRVTISRDNSKNTLYLQFSSLKVEDTA

MFFCAREAGGPIWHDDVKYYDFNDGYYNYHYMDVWGKGTTVTVSS

```
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK
```

1480_I08 gamma heavy chain variable region amino acid sequence: (Kabat CDRs underlined. Chothia CDRs in bold italics)

(SEQ ID NO: 31)
QEQLVESGGGVVQPGGSLRLSCLASGFTFHKYGMHWRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

1480_I08 gamma heavy chain Kabat CDRs:

```
                                    (SEQ ID NO: 88)
CDR 1: KYGMH
                                    (SEQ ID NO: 89)
CDR 2: LISDDGMRKYHSDSMWG
                                    (SEQ ID NO: 6)
CDR 3: EAGGPIWHDDVKYYDFNDGYYNYHYMDV
```

1480_I08 gamma heavy chain Chothia CDRs:

```
                                    (SEQ ID NO: 266)
CDR 1: GFTFHK
                                    (SEQ ID NO: 267)
CDR 2: LISDDGMRKY
                                    (SEQ ID NO: 6)
CDR 3: EAGGPIWHDDVKYYDFNDGYYNYHYMDV
```

1480_I08 lambda light chain nucleotide sequence: 1480_I08 λ2 coding sequence (variable region in bold)

(SEQ ID NO: 67)
ATGGCCTGGGCTCTGCTATTCGTCACCCTCCTCACTCAGGGCACAGGGT
CCTGGGGC**CAGTCTGCCCTGACTCAGCCTGCCTCCGTGTCTGGGTC
TCCTGGACAGACGATCACCATCTCCTGCAATGGAACCAGCAGTGA
CGTTGGTGGATTTGACTCTGTCTCCTGGTATCAACAATCCCCAGG
GAAAGCCCCCAAAGTCATGGTTTTTGATGTCAGTCATCGGCCCTC
AGGTATCTCTAATCGCTTCTCGGCTCCAAGTCCGGCAACACGGC
CTCCCTGACCATCTCTGGGCTCCACATTGAGGACGAGGGCGATTA
TTTCTGCTCTTCACTGACAGACAGAAGCCATCGCATATTCGGCGG
CGGGACCAAGGTGACCGTTCTA**GGTCAGCCCAAGGCTGCCCCCTCG
GTCACTCTGTTCCCGCCCTCCTCTGAGGAGCTTCAAGCCAACAAGGCC
ACACTGGTGTGTCTCATAAGTGACTTCTACCCGGGAGCCGTGACAGTG
GCCTGGAAGGCAGATAGCAGCCCCGTCAAGGCGGGAGTGGAGACCAC
CACACCCTCCAAACAAAGCAACAACAAGTACGCGGCCAGCAGCTACC
TGAGCCTGACGCCTGAGCAGTGGAAGTCCCACAAAAGCTACAGCTGCC
AGGTCACGCATGAAGGGAGCACCGTGGAGAAGACAGTGGCCCCTACA
GAATGTTCATAG

1480_I08 lambda light chain variable region nucleotide sequence:

(SEQ ID NO: 67)
CAGTCTGCCCTGACTCAGCCTGCCTCCGTGTCTGGGTCTCCTGGACAGA
CGATCACCATCTCCTGCAATGGAACCAGCAGTGACGTTGGTGGATTTG
ACTCTGTCTCCTGGTATCAACAATCCCCAGGGAAAGCCCCCAAAGTCA
TGGTTTTTGATGTCAGTCATCGGCCCTCAGGTATCTCTAATCGCTTCTC
TGGCTCCAAGTCCGGCAACACGGCCTCCCTGACCATCTCTGGGCTCCA
CATTGAGGACGAGGGCGATTATTTCTGCTCTTCACTGACAGACAGAAG
CCATCGCATATTCGGCGGCGGGACCAAGGTGACCGTTCTA

1480_I08 lambda light chain amino acid sequence: expressed protein with variable region in bold.

(SEQ ID NO: 14)
**QSALTQPASVSGSPGQTITISCNGTSSDVGGFDSVSWYQQKPSGKAPKV
MVFDVSHRPSGISNRFSGSKSGNTASLTISGLHIEDEGDYFCSSLTDRS
HRIFGGGTKVTVL**GQPKAAPSVTLFPPSSEELQANKATLVCLISDFYPG

AVTVAWKADSSPVKAGVETTTPSKQSNNKYAASSYLSLTPEQWKSHKSY

SCVQTHEGSTVEKTVAPTECS

1480_I08 lambda light chain variable region amino acid sequence: (Kabat CDRs underlined, Chothia CDRs in bold italics)

(SEQ ID NO: 32)
QSALTQPASVSGSPGQTITISC_NGTSSDVGGFDSVS_WYQQSPGKAPKVMVF_DVSHRPS_GISNRFSGSKSGNTASLTISGLHIEDEGDYFC_SSLTDRSHRI_FGGGTKVTVL

1480_I08 lambda light chain Kabat CDRs:

```
                              (SEQ ID NO: 97)
CDR 1:        NGTSSDVGGFDSVS
                              (SEQ ID NO: 95)
CDR 2:        DVSHRPS
                              (SEQ ID NO: 41)
CDR 3:        SSLTDRSHRI
```

1480_I08 lambda light chain Chothia CDRs:

```
                              (SEQ ID NO: 97)
CDR 1:        NGTSSDVGGFDSVS
                              (SEQ ID NO: 95)
CDR 2:        DVSHRPS
                              (SEQ ID NO: 41)
CDR 3:        SSLTDRSHRI
```

The 1469_M23 (PG16) antibody includes a heavy chain variable region (SEQ ID NO: 139), encoded by the nucleic acid sequence shown in SEQ ID NO: 128, and a light chain variable region (SEQ ID NO: 142) encoded by the nucleic acid sequence shown in SEQ ID NO: 129.

The heavy chain CDRs of the 1469_M23 (PG16) antibody have the following sequences per Kabat and Chothia definitions: KYGMH (SEQ ID NO: 88), LISDDGMRKYHSDSMWG (SEQ ID NO: 89), and EAGGPIWHDDVKYYDFNDGYYNYHYMDV (SEQ ID NO: 6). The light chain CDRs of the 1469_M23 (PG16) antibody have the following sequences per Kabat and Chothia definitions: NGTRSDVGGFDSVS (SEQ ID NO: 92), DVSHRPS (SEQ ID NO: 95), and SSLTDRSHRI (SEQ ID NO: 41).

The 1456_A12 (PG16) antibody includes a heavy chain variable region (SEQ ID NO: 47), encoded by the nucleic acid sequence shown in SEQ ID NO: 130, and a light chain variable region (SEQ ID NO: 50) encoded by the nucleic acid sequence shown in SEQ ID NO: 131.

The heavy chain CDRs of the 1456_A12 (PG16) antibody have the following sequences per Kabat and Chothia definitions: KYGMH (SEQ ID NO: 88), LISDDGMRKYHSDSMWG (SEQ ID NO: 89), and EAGGPIWHDDVKYYDFNDGYYNYHYMDV (SEQ ID NO: 6). The light chain CDRs of the 1456 A12 (PG16) antibody have the following sequences per Kabat and Chothia definitions: NGTSRDVGGFDSVS (SEQ ID NO: 93), DVSHRPS (SEQ ID NO: 95), and SSLTDRSHRI (SEQ ID NO: 41).

The 1503_H05 (PG16) antibody includes a heavy chain variable region (SEQ ID NO: 53), encoded by the nucleic acid sequence shown in SEQ ID NO: 132, and a light chain variable region (SEQ ID NO: 56) encoded by the nucleic acid sequence shown in SEQ ID NO: 133.

The heavy chain CDRs of the 1503_H05 (PG16) antibody have the following sequences per Kabat and Chothia definitions: KYGMH (SEQ ID NO: 88), LISDDGMRKYHSDSMWG (SEQ ID NO: 89), and EAGGPIWHDDVKYYDFNDGYYNYHYMDV (SEQ ID NO: 6). The light chain CDRs of the 1503_1-105 (PG16) antibody have the following sequences per Kabat and Chothia definitions: NGTRSDVGGFDSVS (SEQ ID NO: 92), DVSHRPS (SEQ ID NO: 95), and SSLTDRSHRI (SEQ ID NO: 41).

The 1489_I13 (PG16) antibody includes a heavy chain variable region (SEQ ID NO: 59), encoded by the nucleic acid sequence shown in SEQ ID NO: 134, and a light chain variable region (SEQ ID NO: 14) encoded by the nucleic acid sequence shown in SEQ ID NO: 135.

The heavy chain CDRs of the 1489_I13 (PG16) antibody have the following sequences per Kabat and Chothia definitions: KYGMH (SEQ ID NO: 88), LISDDGMRKYHSNSMWG (SEQ ID NO: 98), and EAGGPIWHDDVKYYDFNDGYYNYHYMDV (SEQ ID NO: 6). The light chain CDRs of the 1489_I13 (PG16) antibody have the following sequences per Kabat and Chothia definitions: NGTSSDVGGFDSVS (SEQ ID NO: 97), DVSHRPS (SEQ ID NO: 95), and SSLTDRSHRI (SEQ ID NO: 41).

The 1480_I08 (PG16) antibody includes a heavy chain variable region (SEQ ID NO: 65), encoded by the nucleic acid sequence shown in SEQ ID NO: 136, and a light chain variable region (SEQ ID NO: 14) encoded by the nucleic acid sequence shown in SEQ ID NO: 137.

The heavy chain CDRs of the 1480_I08 (PG16) antibody have the following sequences per Kabat and Chothia definitions: KYGMH (SEQ ID NO: 88), LISDDGMRKYHSDSMWG (SEQ ID NO: 89), and EAGGPIWHDDVKYYDFNDGYYNYHYMDV (SEQ ID NO: 6). The light chain CDRs of the 1480_I08 (PG16) antibody have the following sequences per Kabat and Chothia definitions: NGTSSDVGGFDSVS (SEQ ID NO: 97), DVSHRPS (SEQ ID NO: 95), and SSLTDRSHRI (SEQ ID NO: 41).

The sequences of additional human monoclonal antibodies were determined, including the sequences of the variable regions of the Gamma heavy and Kappa or Lambda light chains. In addition, the sequence of each of the polynucleotides encoding the antibody sequences was determined. Shown below are the polypeptide and polynucleotide sequences of the gamma heavy chains and kappa light chains, with the signal peptides at the N-terminus (or 5' end) and the constant regions at the C-terminus (or 3' end) of the variable regions, which are shown in bolded text.

4838_L06 (PGT-121) gamma heavy chain nucleotide sequence: coding sequence (variable region in bold)

```
(SEQ ID NO: 62)
ATGAAACACCTGTGGTTCTTCCTTCTCCTGGTGGCAGCTCCCAGATGGG

TCCTGTCACAGATGCAGTTACAGGAGTCGGGCCCCGGACTGGTGAAGCC

TTCGGAAACCCTGTCCCTCACGTGCAGTGTGTCTGGTGCCTCCATAAGT

GACAGTTACTGGAGCTGGATCCGGCGGTCCCCAGGGAAGGGACTTGAGT

GGATTGGGTATGTCCACAAAAGCGGCGACACAAATTACAGCCCCTCCCT

CAAGAGTCGAGTCAACTTGTCGTTAGACACGTCCAAAAATCAGGTGTCC

CTGAGCCTTGTGGCCGCGACCGCTGCGGACTCGGGCAAATATTATTGCG

CGAGAACACTGCACGGGAGGAGAATTTATGGAATCGTTGCCTTCAATGA

GTGGTTCACCTACTTCTACATGGACGTCTGGGGCAATGGGACTCAGGTC

ACCGTCTCCTCAGCCTCCACCAAGGGCCCATCGGTCTTCCCCCTGGCAC

CCTCCTCCAAGAGCACCTCTGGGGGCACAGCGGCCCTGGGCTGCCTGGT

CAAGGACTACTTCCCCGAACCGGTGACGGTGTCGTGGAACTCAGGCGCC

CTGACCAGCGGCGTGCACACCTTCCCGGCTGTCCTACAGTCCTCAGGAC

TCTACTCCCTCAGCAGCGTGGTGACCGTGCCCTCCAGCAGCTTGGGCAC

CCAGACCTACATCTGCAACGTGAATCACAAGCCCAGCAACACCAAGGTG

GACAAGAGAGTTGAGCCCAAATCTTGTGACAAAACTCACACATGCCCAC

CGTGCCCAGCACCTGAACTCCTGGGGGGACCGTCAGTCTTCCTCTTCCC

CCCAAAACCCAAGGACACCCTCATGATCTCCCGGACCCCTGAGGTCACA

TGCGTGGTGGTGGACGTGAGCCACGAAGACCCTGAGGTCAAGTTCAACT

GGTACGTGGACGGCGTGGAGGTGCATAATGCCAAGACAAAGCCGCGGGA

GGAGCAGTACAACAGCACGTACCGTGTGGTCAGCGTCCTCACCGTCCTG

CACCAGGACTGGCTGAATGGCAAGGAGTACAAGTGCAAGGTCTCCAACA

AAGCCCTCCCAGCCCCCATCGAGAAAACCATCTCCAAAGCCAAAGGGCA

GCCCCGAGAACCACAGGTGTACACCCTGCCCCCATCCCGGGAGGAGATG

ACCAAGAACCAGGTCAGCCTGACCTGCCTGGTCAAAGGCTTCTATCCCA

GCGACATCGCCGTGGAGTGGGAGAGCAATGGGCAGCCGGAGAACAACTA

CAAGACCACGCCTCCCGTGCTGGACTCCGACGGCTCCTTCTTCCTCTAT

AGCAAGCTCACCGTGGACAAGAGCAGGTGGCAGCAGGGGAACGTCTTCT

CATGCTCCGTGATGCATGAGGCTCTGCACAACCACTACACGCAGAAGAG

CCTCTCCCTGTCTCCGGGTAAATGA
```

4838_L06 (PGT-121) gamma heavy chain variable region nucleotide sequence:

(SEQ ID NO: 63)
CAGATGCAGTTACAGGAGTCGGGCCCCGGACTGGTGAAGCCTTCGGAAA
CCCTGTCCCTCACGTGCAGTGTGTCTGGTGCCTCCATAAGTGACAGTTA
CTGGAGCTGGATCCGGCGGTCCCCAGGGAAGGGACTTGAGTGGATTGGG
TATGTCCACAAAAGCGGCGACACAAATTACAGCCCCTCCCTCAAGAGTC
GAGTCAACTTGTCGTTAGACACGTCCAAAAATCAGGTGTCCCTGAGCCT
TGTGGCCGCGACCGCTGCGGACTCGGGCAAATATTATTGCGCGAGAACA
CTGCACGGGAGGAGAATTTATGGAATCGTTGCCTTCAATGAGTGGTTCA
CCTACTTCTACATGGACGTCTGGGGCAATGGGACTCAGGTCACCGTCTC
CTCA

4838_L06 (PGT-121) gamma heavy chain amino acid sequence: expressed protein with variable region in bold.

(SEQ ID NO: 66)
QMQLQESGPGLVKPSETLSLTCSVSGASISDSYWSWIRRSPGKGLEWIG
YVHKSGDTNYSPSLKSRVNLSLDTSKNQVSLSLVAATAADSGKYYCART
LHGRRIYGIVAFNEWFTYFYMDVWGNGTQVTVSSASTKGPSVFPLAPSS
KSTSGGTAALGCLVKDYFPEPVTVSWNSGALTSGVHTFPAVLQSSQLYS
LSSVVTVPSSSLGTQTYICNVNHKPSNTKVDKRVEPKSCDKTHTCPPCP
APELLGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDI
AVEWESNGQPENNYKTTPPVLDSDGSFFLYSKLTVDKSRWQQGNVFSCS
VMHEALHNHYTQKSLSLPGK

4838_L06 (PGT-121) gamma heavy chain variable region amino acid sequence: (Kabat CDRs underlined, Chothia CDRs in bold italics)

(SEQ ID NO: 79)
QMQLQESGPGLVKPSETLSLTCSVS*GASISD*SYWSWIRRS
PGKGLEWIG*YVHKSGDTNY*SPSLKSRVNLSLDTSKNQVSLS
LVAATAADSGKYYCAR*TLHGRRIY*
*GIVAFNEWFTYFYMDV*WGNGTQVTVSS

4838_L06 (PGT-121) gamma heavy chain Kabat CDRs:

(SEQ ID NO: 90)
CDR 1: DSYWS (SEQ ID NO: 265)
CDR 2: YVHKSGDTNYSPSLKS (SEQ ID NO: 143)
CDR 3: TLHGRRIYGIVAFNEWFTYFYMDV

4838_L06 (PGT-121) gamma heavy chain Chothia CDRs:

(SEQ ID NO: 144)
CDR 1: GASISD (SEQ ID NO: 145)
CDR 2: YVHKSGDTN (SEQ ID NO: 143)
CDR 3: TLHGRRIYGIVAFNEWFTYFYMDV

4838_L06 (PGT-121) lambda light chain nucleotide sequence: coding sequence (variable region in bold)

(SEQ ID NO: 146)
ATGGCCTGGACCTTTCTCCTCCTCGGCCTCCTCTCTCACTGCACAGCCT
CTGTGACC**TCCGATATATCTGTGGCCCCAGGAGAGACGGCCAGGATTTC
CTGTGGGGAAAAGAGCCTTGGAAGTAGAGCTGTACAATGGTATCAACAC
AGGGCCGGCCAGGCCCCCTCTTTAATCATATATAATAATCAGGACCGGC
CCTCAGGGATCCCTGAGCGATTCTCTGGCTCCCCTGACTCCCCTTTTGG
GACCACGGCCACCCTGACCATCACCAGTGTCGAAGCCGGGGATGAGGCC
GACTATTACTGTCATATATGGGATAGTAGAGTTCCCACCAAATGGGTCT
TCGGCGGAGGGACCACGCTGACCGTGTTA**GGTCAGCCCAAGGCTGCCCC
CTCGGTCACTCTGTTCCCGCCCTCCTCTGAGGAGCTTCAAGCCAACAAG
GCCACACTGGTGTGTCTCATAAGTGACTTCTACCCGGGAGCCGTGACAG
TGGCCTGGAAGGCAGATAGCAGCCCCGTCAAGGCGGGAGTGGAGACCAC
CACACCCTCCAAACAAAGCAACAACAAGTACGCGGCCAGCAGCTACCTG
AGCCTGACGCCTGAGCAGTGGAAGTCCCACAAAAGCTACAGCTGCCAGG
TCACGCATGAAGGGAGCACCGTGGAGAAGACAGTGGCCCCTACAGAATG
TTCATAG

4838_L06 (PGT-121) lambda light chain variable region nucleotide sequence:

(SEQ ID NO: 147)
TCCGATATATCTGTGGCCCCAGGAGAGACGGCCAGGATTTCCTGTGGGG
AAAAGAGCCTTGGAAGTAGAGCTGTACAATGGTATCAACACAGGGCCGG
CCAGGCCCCCTCTTTAATCATATATAATAATCAGGACCGGCCCTCAGGG
ATCCCTGAGCGATTCTCTGGCTCCCCTGACTCCCCTTTTGGGACCACGG
CCACCCTGACCATCACCAGTGTCGAAGCCGGGGATGAGGCCGACTATTA
CTGTCATATATGGGATAGTAGAGTTCCCACCAAATGGGTCTTCGGCGGA
GGGACCACGCTGACCGTGTTA

4838_L06 (PGT-121) lambda light chain amino acid sequence: expressed protein with variable region in bold.

(SEQ ID NO: 148)
**SDISVAPGETARISCGEKSLGSRAVQWYQHRAGQAPSLIIYNNQDRPSG
IPERFSGSPDSPFGTTATLTITSVEAGDEADYYCHIWDSRVPTKWVFGG
GTTLTVL**GQPKAAPSVTLFPPSSEELQANKATLVCLISDFYPGAVTVAW
KADSSPVKAGVETTTPSKQSNNKYAASSYLSLTPEQWKSHKSYSCQVTH
EGSTVEKTVAPTECS

4838_L06 (PGT-121) lambda light chain variable region amino acid sequence: (Kabat CDRs underlined, Chothia CDRs in bold italics)

(SEQ ID NO: 149)
SDISVAPGETARISC*GEKSLGSRAVQ*WYQHRAGQAPSLI
IY*__NNQDRPS__*GIPERFSGSPDSPFGTTATLTITSVEAGDE
ADYYC*__HIWDSRVPTKWV__*FGGGTTLTVL

4838_L06 (PGT-121) lambda light chain Kabat CDRs:

```
                                 (SEQ ID NO: 150)
         CDR 1:             GEKSLGSRAVQ
                                 (SEQ ID NO: 151)
         CDR 2:             NNQDRPS
                                 (SEQ ID NO: 152)
         CDR 3:             HIWDSRVPTKWV
```

4838_L06 (PGT-121) lambda light chain Chothia CDRs:

```
                                 (SEQ ID NO: 150)
         CDR 1: GEKSLGSRAVQ
                                 (SEQ ID NO: 151)
         CDR 2: NNQDRPS
                                 (SEQ ID NO: 152)
         CDR 3: HIWDSRVPTKWV
```

4873_E03 (PGT-121) gamma heavy chain nucleotide sequence: coding sequence (variable region in bold)

(SEQ ID NO: 62)
ATGAAACACCTGTGGTTCTTCCTTCTCCTGGTGGCAGCTCCCAGATGGG
TCCTGTCCAGATGCAGTTACAGGAGTCGGGCCCCGGACTGGTGAA
GCCTTCGGAAACCCTGTCCCTCACGTGCAGTGTGTCTGGTGCCTC
CATAAGTGACAGTTACTGGAGCTGGATCCGGCGGTCCCCAGGGAA
GGGACTTGAGTGGATTGGGTATGTCCACAAAAGCGGCGACACAAA
TTACATCCCCTCCCTCAAGAGTCGAGTCAACTTGTCGTTAGACACG
TCCAAAAATCAGGTGTCCCTGAGCCTTGTGGCCGCGACCGCTGCG
GACTCGGGCAAATATTATTGCGCGAGAACACTGCACGGGAGGAGA
ATTTATGGAATCGTTGCCTTCAATGAGTGGTTCACCTACTTCTACA
TGGACGTCTGGGGCAATGGGACTCAGGTCACCGTCTCCTCAGCCT
CCACCAAGGGCCCATCGGTCTTCCCCCTGGCACCCTCCTCCAAGAGCA
CCTCTGGGGGCACAGCGGCCCTGGGCTGCCTGGTCAAGGACTACTTCC
CCGAACCGGTGACGGTGTCGTGGAACTCAGGCGCCCTGACCAGCGGC
GTGCACACCTTCCCGGCTGTCCTACAGTCCTCAGGACTCTACTCCCTCA
GCAGCGTGGTGACCGTGCCCTCCAGCAGCTTGGGCACCCAGACCTACA
TCTGCAACGTGAATCACAAGCCCAGCAACACCAAGGTGGACAAGAGA
GTTGAGCCCAAATCTTGTGACAAAACTCACACATGCCCACCGTGCCCA
GCACCTGAACTCCTGGGGGGACCGTCAGTCTTCCTCTTCCCCCCAAAA
CCCAAGGACACCCTCATGATCTCCCGGACCCCTGAGGTCACATGCGTG
GTGGTGGACGTGAGCCACGAAGACCCTGAGGTCAAGTTCAACTGGTAC
GTGGACGGCGTGGAGGTGCATAATGCCAAGACAAAGCCGCGGGAGGA
GCAGTACAACAGCACGTACCGTGTGGTCAGCGTCCTCACCGTCCTGCA

CCAGGACTGGCTGAATGGCAAGGAGTACAAGTGCAAGGTCTCCAACA
AAGCCCTCCCAGCCCCCATCGAGAAAACCATCTCCAAAGCCAAAGGG
CAGCCCCGAGAACCACAGGTGTACACCCTGCCCCCATCCCGGGAGGA
GATGACCAAGAACCAGGTCAGCCTGACCTGCCTGGTCAAAGGCTTCTA
TCCCAGCGACATCGCCGTGGAGTGGGAGAGCAATGGGCAGCCGGAGA
ACAACTACAAGACCACGCCTCCCGTGCTGGACTCCGACGGCTCCTTCT
TCCTCTATAGCAAGCTCACCGTGGACAAGAGCAGGTGGCAGCAGGGG
AACGTCTTCTCATGCTCCGTGATGCATGAGGCTCTGCACAACCACTAC
ACGCAGAAGAGCCTCTCCCTGTCTCCGGGTAAATGA

4873_E03 (PGT-121) gamma heavy chain variable region nucleotide sequence:

(SEQ ID NO: 63)
CAGATGCAGTTACAGGAGTCGGGCCCCGGACTGGTGAAGCCTTCGGAA
ACCCTGTCCCTCACGTGCAGTGTGTCTGGTGCCTCCATAAGTGACAGTT
ACTGGAGCTGGATCCGGCGGTCCCCAGGGAAGGGACTTGAGTGGATTG
GGTATGTCCACAAAAGCGGCGACACAAATTACGCCCCTCCCTCAAGA
GTCGAGTCAACTTGTCGTTAGACACGTCCAAAAATCAGGTGTCCCTGA
GCCTTGTGGCCGCGACCGCTGCGGACTCGGGCAAATATTATTGCGCGA
GAACACTGCACGGGAGGAGAATTTATGGAATCGTTGCCTTCAATGAGT
GGTTCACCTACTTCTACATGGACGTCTGGGGCAATGGGACTCAGGTCA
CCGTCTCCTCA

4873_E03 (PGT-121) gamma heavy chain amino acid sequence: expressed protein with variable region in bold.

(SEQ ID NO: 66)
MKHLWFFLLLVAAPRWVLSQMQLQESGPGLVKPSETLSLTCSVSGAS
ISDSYWSWIRRSPGKGLEWIGYVHKSGDTNYIPSLKSRVNLSLDTSKN
QVSLSLVAATAADSGKYYCARTLHGRRIYGIVAFNEWFTYFYMDVW
GNGTQVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPS
NTKVDKRVEPKSCDKTHTCPPCPAPELLGGPSVFLFPPKPKDTLMISRTP
EVTCVVVDVSHEDPEVKFNWYVDGVEVHNAKTKPREEQYNSTYRVVSVLT
VLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLY
SKLTVDKSRWQQGNVFSCSVMHEALHNHYTQKSLSLSPGK

4873_E03 (PGT-121) gamma heavy chain variable region amino acid sequence: (Kabat CDRs underlined, Chothia CDRs in bold italics)

(SEQ ID NO: 79)
QMQLQESGPGLVKPSETLSLTCSVS*GASISD*__SYWS__WIRRSPGKGLEW
IG*YVHKSGDTN*__YSPSLKS__RVNLSLDTSKNQVSLSLVAATAADSGKY
YCAR*TLHGRRIYGIVAFNEWFTYFYMDV*WGNGTQVTVSS

4873_E03 (PGT-121) gamma heavy chain Kabat CDRs:

```
                                      (SEQ ID NO: 90)
        CDR 1: DSYWS
                                      (SEQ ID NO: 265)
        CDR 2: YVHKSGDTNYSPSLKS
                                      (SEQ ID NO: 143)
        CDR 3: TLHGRRIYGIVAFNEWFTYFYMDV
```

4873_E03 (PGT-121) gamma heavy chain Chothia CDRs:

```
                                      (SEQ ID NO: 144)
        CDR 1: GASISD
                                      (SEQ ID NO: 145)
        CDR 2: YVHKSGDTN
                                      (SEQ ID NO: 143)
        CDR 3: TLHGRRIYGIVAFNEWFTYFYMDV
```

4873_E03 (PGT-121) lambda light chain nucleotide sequence: coding sequence (variable region in bold)

(SEQ ID NO: 146)
ATGGCCTGGACCTTTCTCCTCCTCGGCCTCCTCTCTCACTGCACAGCCT
CTGTGACCTCCGATATATCTGTGGCCCCAGGAGAGACGGCCAGGA
TTTCCTGTGGGGAAAAGAGCCTTGGAAGTAGAGCTGTACAATGGT
ATCAACACAGGGCCGGCCAGGCCCCCTCTTTAATCATATATAATAA
TCAGGACCGGCCCTCAGGGATCCCTGAGCGATTCTCTGGCTCCCC
TGACTCCCCTTTTGGGACCACGGCCACCCTGACCATCACCAGTGT
CGAAGCCGGGGATGAGGCCGACTATTACTGTCATATATGGGATAG
TAGAGTTCCCACCAAATGGGTCTTCGGCGGAGGGACCACGCTGAC
CGTGTTAGGTCAGCCCAAGGCTGCCCCCTCGGTCACTCTGTTCCCGCC
CTCCTCTGAGGAGCTTCAAGCCAACAAGGCCACACTGGTGTGTCTCAT
AAGTGACTTCTACCCGGGAGCCGTGACAGTGGCCTGGAAGGCAGATA
GCAGCCCCGTCAAGGCGGGAGTGGAGACCACCACACCCTCCAAACAA
AGCAACAACAAGTACGCGGCCAGCAGCTACCTGAGCCTGACGCCTGA
GCAGTGGAAGTCCCACAAAAGCTACAGCTGCCAGGTCACGCATGAAG
GGAGCACCGTGGAGAAGACAGTGGCCCCTACAGAATGTTCATAG

4873_E03 (PGT-121) lambda light chain variable region nucleotide sequence:

(SEQ ID NO: 147)
TCCGATATATCTGTGGCCCCAGGAGAGACGGCCAGGATTTCCTGTGGG
GAAAAGAGCCTTGGAAGTAGAGCTGTACAATGGTATCAACACAGGGC
CGGCCAGGCCCCCTCTTTAATCATATATAATAATCAGGACCGGCCCTC
AGGGATCCCTGAGCGATTCTCTGGCTCCCCTGACTCCCCTTTTGGGACC
ACGGCCACCCTGACCATCACCAGTGTCGAAGCCGGGGATGAGGCCGA
CTATTACTGTCATATATGGGATAGTAGAGTTCCCACCAAATGGGTCTTC
GGCGGAGGGACCACGCTGACCGTGTTA

4873_E03 (PGT-121) lambda light chain amino acid sequence: expressed protein with variable region in bold.

(SEQ ID NO: 148)
MAWTFLLLGLLSHCTASVTSDISVAPGETARISCGEKSLGSRAVQWY
QHRAGQAPSLIIYNNQDRPSGIPERFSGSPDSPFGTTATLTITSVEAGDE
ADYYCHIWDSRVPTKWVFGGGTTLTVLGQPKAAPSVTLFPPSSEELQA
NKATLVCLISDFYPGAVTVAWKADSSPVKAGVETTTPSKQSNNKYAASS
YLSLTPEQWKSHKSYSCQVTHEGSTVEKTVAPTECS

4873_E03 (PGT-121) lambda light chain variable region amino acid sequence: (Kabat CDRs underlined, Chothia CDRs in bold italics)

(SEQ ID NO: 149)
SDISVAPGETARISC*GEKSLGSRAVQ*WYQHRAGQAPSLIIY<u>*NNQDRPS*</u>
GIPERFSGSPDSPFGTTATLTITSVEAGDEADYYC<u>*HIWDSRVPTKWV*</u>F
GGGTTLTVL

4873_E03 (PGT-121) lambda light chain Kabat CDRs:

```
                                      (SEQ ID NO: 150)
        CDR 1: GEKSLGSRAVQ
                                      (SEQ ID NO: 151)
        CDR 2: NNQDRPS
                                      (SEQ ID NO: 152)
        CDR 3: HIWDSRVPTKWV
```

4873_E03 (PGT-121) lambda light chain Chothia CDRs:

```
                                      (SEQ ID NO: 150)
        CDR 1: GEKSLGSRAVQ
                                      (SEQ ID NO: 151)
        CDR 2: NNQDRPS
                                      (SEQ ID NO: 152)
        CDR 3: HIWDSRVPTKWV
```

4877_D15 (PGT-122) gamma heavy chain nucleotide sequence: coding sequence (variable region in bold)

(SEQ ID NO: 153)
ATGAAACACCTGTGGTTCTTCCTTCTCCTGGTGGCAGCTCCCAGATGGG
TCCTGTCCCAGGTTCATCTGCAGGAGTCGGGCCCCGGACTGGTGAA
GCCTTCGGAGACCCTGTCCCTCACGTGCAATGTGTCTGGGACCCT
CGTGCGTGATAACTACTGGAGCTGGATCAGACAACCCCTCGGGAA
GCAACCTGAGTGGATTGGCTATGTCCATGACAGCGGGGACACGAA
TTACAACCCCTCCCTGAAGAGTCGAGTCCACTTATCGTTGGACAA
GTCCAAAAACCTGGTGTCCCTGAGGCTGACCGGCGTGACCGCCGC
GGACTCGGCCATATATTATTGCGCGACAACAAAACACGGGAGGAG
GATTTATGGCGTCGTTGCCTTCAAAGAGTGGTTCACCTATTTCTAC
ATGGACGTCTGGGGCAAAGGGACTTCGGTCACCGTCTCCTCAGCC
TCCACCAAGGGCCCATCGGTCTTCCCCCTGGCACCCTCCTCCAAGAGC
ACCTCTGGGGGCACAGCGGCCCTGGGCTGCCTGGTCAAGGACTACTTC
CCCGAACCGGTGACGGTGTCGTGGAACTCAGGCGCCCTGACCAGCGGC

-continued

```
GTGCACACCTTCCCGGCTGTCCTACAGTCCTCAGGACTCTACTCCCTCA

GCAGCGTGGTGACCGTGCCCTCCAGCAGCTTGGGCACCCAGACCTACA

TCTGCAACGTGAATCACAAGCCCAGCAACACCAAGGTGGACAAGAGA

GTTGAGCCCAAATCTTGTGACAAAACTCACACATGCCCACCGTGCCCA

GCACCTGAACTCCTGGGGGGACCGTCAGTCTTCCTCTTCCCCCCAAAA

CCCAAGGACACCCTCATGATCTCCCGGACCCCTGAGGTCACATGCGTG

GTGGTGGACGTGAGCCACGAAGACCCTGAGGTCAAGTTCAACTGGTAC

GTGGACGGCGTGGAGGTGCATAATGCCAAGACAAAGCCGCGGGAGGA

GCAGTACAACAGCACGTACCGTGTGGTCAGCGTCCTCACCGTCCTGCA

CCAGGACTGGCTGAATGGCAAGGAGTACAAGTGCAAGGTCTCCAACA

AAGCCCTCCCAGCCCCCATCGAGAAAACCATCTCCAAAGCCAAAGGG

CAGCCCCGAGAACCACAGGTGTACACCCTGCCCCCATCCCGGGAGGA

GATGACCAAGAACCAGGTCAGCCTGACCTGCCTGGTCAAAGGCTTCTA

TCCCAGCGACATCGCCGTGGAGTGGGAGAGCAATGGGCAGCCGGAGA

ACAACTACAAGACCACGCCTCCCGTGCTGGACTCCGACGGCTCCTTCT

TCCTCTATAGCAAGCTCACCGTGGACAAGAGCAGGTGGCAGCAGGGG

AACGTCTTCTCATGCTCCGTGATGCATGAGGCTCTGCACAACCACTAC

ACGCAGAAGAGCCTCTCCCTGTCTCCGGGTAAATGA
```

4877_D15 (PGT-122) gamma heavy chain variable region nucleotide sequence:

```
                                         (SEQ ID NO: 154)
CAGGTTCATCTGCAGGAGTCGGGCCCCGGACTGGTGAAGCCTTCGGAG

ACCCTGTCCCTCACGTGCAATGTGTCTGGGACCCTCGTGCGTGATAACT

ACTGGAGCTGGATCAGACAACCCCTCGGGAAGCAACCTGAGTGGATTG

GCTATGTCCATGACAGCGGGGACACGAATTACAACCCCTCCCTGAAGA

GTCGAGTCCACTTATCGTTGGACAAGTCCAAAAACCTGGTGTCCCTGA

GGCTGACCGGCGTGACCGCCGCGGACTCGGCCATATATTATTGCGCGA

CAACAAAACACGGGAGGAGGATTTATGGCGTCGTTGCCTTCAAAGAGT

GGTTCACCTATTTCTACATGGACGTCTGGGGCAAAGGGACTTCGGTCA

CCGTCTCCTCA
```

4877_D15 (PGT-122) gamma heavy chain amino acid sequence: expressed protein with variable region in bold.

```
                                         (SEQ ID NO: 155)
MKHLWFFLLLVAAPRWVLSQVHLQESGPGLVKPSETLSLTCNVSGTL

VRDNYWSWIRQPLGKQPEWIGYVHDSGDTNYNPSLKSRVHLSLDKSK

NLVSLRLTGVTAADSAIYYCATTKHGRRIYGVVAFKEWFTYFYMDV

WGKGTSVTVSSASTKGPSVFPLAPSSKSTSGGTAALGCLVKDYFPEPVTV

SWNSGALTSGVHTFPAVLQSSGLYSLSSVVTVPSSSLGTQTYICNVNHKP

SNTKVDKRVEPKSCDKTHTCPPCPAPELLGGPSVFLFPPKPKDTLMISRT

PEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSRE

EMTKNQVSLTCLVKGFYPSDIAVEWESNGQPENNYKTTPPVLDSDGSFFL

YSKLTVDKSRWQQGNVFSCSVMHEALHNHYTQKSLSLSPGK
```

4877_D15 (PGT-122) gamma heavy chain variable region amino acid sequence:
(Kabat CDRs underlined, Chothia CDRs in bold italics)

```
                                         (SEQ ID NO: 156)
QVHLQESGPGLVKPSETLSLTCNVS*GTLVRD*NYWSWIRQPLGKQPEWIG

*YVHDSGDTN*YNPSLKSRVHLSLDKSKNLVSLRLTGVTAADSAIYYCAT

*TKHGRRIYGVVAFKEWFTYFYMDV*WGKGTSVTVSS
```

4877_D15 (PGT-122) gamma heavy chain Kabat CDRs:

```
CDR 1:   DNYWS                       (SEQ ID NO: 261)
CDR 2:   YVHDSGDTNYNPSLKS            (SEQ ID NO: 157)
CDR 3:   TKHGRRIYGVVAFKEWFTYFYMDV    (SEQ ID NO: 262)
```

4877_D15 (PGT-122) gamma heavy chain Chothia CDRs:

```
CDR 1:   GTLVRD                      (SEQ ID NO: 263)
CDR 2:   YVHDSGDTN                   (SEQ ID NO: 264)
CDR 3:   TKHGRRIYGVVAFKEWFTYFYMDV    (SEQ ID NO: 262)
```

4877_D15 (PGT-122) lambda light chain nucleotide sequence: coding sequence (variable region in bold)

```
                                         (SEQ ID NO: 158)
ATGGCCTGGACCGTTCTCCTCCTCGGCCTCCTCTCTCACTGCACAGGCG

CGGTGTCTACCTTTGTGTCAGTGGCCCCAGGACAGACGGCCAGGAT

TACTTGTGGGGAAGAGAGCCTTGGAAGTAGATCTGTTATTTGGTA

TCAACAGAGGCCAGGCCAGGCCCCTTCATTAATCATCTATAATAAT

AATGACCGGCCCTCAGGGATTCCTGACCGATTTTCTGGGTCCCCT

GGCTCCACTTTTGGGACCACGGCCACCCTGACCATCACCAGTGTC

GAAGCCGGGGATGAGGCCGACTATTATTGTCATATCTGGGATAGT

AGACGACCAACCAATTGGGTCTTCGGCGAAGGGACCACACTGATC

GTGTTAGGTCAGCCCAAGGCTGCCCCCTCGGTCACTCTGTTCCCGCCC

TCCTCTGAGGAGCTTCAAGCCAACAAGGCCACACTGGTGTGTCTCATA

AGTGACTTCTACCCGGGAGCCGTGACAGTGGCCTGGAAGGCAGATAGC

AGCCCCGTCAAGGCGGGAGTGGAGACCACCACACCCTCCAAACAAAG

CAACAACAAGTACGCGGCCAGCAGCTACCTGAGCCTGACGCCTGAGC

AGTGGAAGTCCCACAAAAGCTACAGCTGCCAGGTCACGCATGAAGGG

AGCACCGTGGAGAAGACAGTGGCCCCTACAGAATGTTCATAG
```

4877 D15 (PGT-122) lambda light chain variable region nucleotide sequence:

```
                                         (SEQ ID NO: 159)
ACCTTTGTGTCAGTGGCCCCAGGACAGACGGCCAGGATTACTTGTGGG
```

```
GAAGAGAGCCTTGGAAGTAGATCTGTTATTTGGTATCAACAGAGGCCA

GGCCAGGCCCCTTCATTAATCATCTATAATAATAATGACCGGCCCTCA

GGGATTCCTGACCGATTTTCTGGGTCCCCTGGCTCCACTTTTGGGACCA

CGGCCACCCTGACCATCACCAGTGTCGAAGCCGGGGATGAGGCCGACT

ATTATTGTCATATCTGGGATAGTAGACGACCAACCAATTGGGTCTTCG

GCGAAGGGACCACACTGATCGTGTTA
```

4877_D15 (PGT-122) lambda light chain amino acid sequence: expressed protein with variable region in bold.

(SEQ ID NO: 160)
MAWTVLLLGLLSHCTGAVSTFVSVAPGQTARITCGEESLGSRSVIWY

QQRPGQAPSLIIYNNNDRPSGIPDRFSGSPGSTFGTTATLTITSVEAGDE

ADYYCHIWDSRRPTNWVFGEGTTLIVLGQPKAAPSVTLFPPSSEELQAN

KATLVCLISDFYPGAVTVAWKADSSPVKAGVETTTPSKQSNNKYAASSYL

SLTPEQWKSHKSYSCQVTHEGSTVEKTVAPTECS

4877_D15 (PGT-122) lambda light chain variable region amino acid sequence: (Kabat CDRs underlined, Chothia CDRs in bold italics)

(SEQ ID NO: 161)
TFVSVAPGQTARITC*GEESLGSRSVI*WYQQRPGQAPSLIIY *NNNDRPS*

GIPDRFSGSPGSTFGTTATLTITSVEAGDEADYYC *HIWDSRRPTNWV*

FGEGTTLIVL

4877_D15 (PGT-122) lambda light chain Kabat CDRs:

```
    CDR 1:    GEESLGSRSVI      (SEQ ID NO: 162)
    CDR 2:    NNNDRPS          (SEQ ID NO: 163)
    CDR 3:    HIWDSRRPTNWV     (SEQ ID NO: 164)
```

4877_D15 (PGT-122) lambda light chain Chothia CDRs:

```
    CDR 1:    GEESLGSRSVI      (SEQ ID NO: 162)
    CDR 2:    NNNDRPS          (SEQ ID NO: 163)
    CDR 3:    HIWDSRRPTNWV     (SEQ ID NO: 164)
```

4858_P08 (PGT-123) gamma heavy chain nucleotide sequence: coding sequence (variable region in bold)

(SEQ ID NO: 165)
```
ATGAAACACCTGTGGATCTTCCTTCTCCTGGTGGCAACTCCCAGATGG

GTCGAGTCCAGCTGCACCTGCAGGAGTCGGGCCCAGGGCTGGTG

AAGCCTCCGGAGACCCTGTCCCTCACGTGTAGTGTGTCTGGCGCC

TCCATCAATGATGCCTATTGGAGTTGGATTCGGCAGTCCCCAGGG

AAGCGGCCTGAGTGGGTTGGATATGTCCATCACAGCGGTGACACA

AATTATAATCCCTCACTCAAGAGGCGCGTCACGTTTTCATTAGACA

CGGCCAAGAATGAAGTGTCCCTGAAATTAGTAGACCTGACCGCTG

CGGACTCGGCCACATATTTTTGTGCGCGAGCACTTCACGGGAAGA

GGATTTATGGGATAGTTGCCCTCGGAGAGTTGTTCACCTACTTCTA

CATGGACGTCTGGGGCAAGGGGACTGCGGTCACCGTCTCCTCAGC

CTCCACCAAGGGCCCATCGGTCTTCCCCCTGGCACCCTCCTCCAAGAG

CACCTCTGGGGGCACAGCGGCCCTGGGCTGCCTGGTCAAGGACTACTT

CCCCGAACCGGTGACGGTGTCGTGGAACTCAGGCGCCCTGACCAGCGG

CGTGCACACCTTCCCGGCTGTCCTACAGTCCTCAGGACTCTACTCCCTC

AGCAGCGTGGTGACCGTGCCCTCCAGCAGCTTGGGCACCCAGACCTAC

ATCTGCAACGTGAATCACAAGCCCAGCAACACCAAGGTGGACAAGAG

AGTTGAGCCCAAATCTTGTGACAAAACTCACACATGCCCACCGTGCCC

AGCACCTGAACTCCTGGGGGGACCGTCAGTCTTCCTCTTCCCCCCAAA

ACCCAAGGACACCCTCATGATCTCCCGGACCCCTGAGGTCACATGCGT

GGTGGTGGACGTGAGCCACGAAGACCCTGAGGTCAAGTTCAACTGGTA

CGTGGACGGCGTGGAGGTGCATAATGCCAAGACAAAGCCGCGGGAGG

AGCAGTACAACAGCACGTACCGTGTGGTCAGCGTCCTCACCGTCCTGC

ACCAGGACTGGCTGAATGGCAAGGAGTACAAGTGCAAGGTCTCCAAC

AAAGCCCTCCCAGCCCCCATCGAGAAAACCATCTCCAAAGCCAAAGG

GCAGCCCCGAGAACCACAGGTGTACACCCTGCCCCCATCCCGGGAGG

AGATGACCAAGAACCAGGTCAGCCTGACCTGCCTGGTCAAAGGCTTCT

ATCCCAGCGACATCGCCGTGGAGTGGGAGAGCAATGGGCAGCCGGAG

AACAACTACAAGACCACGCCTCCCGTGCTGGACTCCGACGGCTCCTTC

TTCCTCTATAGCAAGCTCACCGTGGACAAGAGCAGGTGGCAGCAGGGG

AACGTCTTCTCATGCTCCGTGATGCATGAGGCTCTGCACAACCACTAC

ACGCAGAAGAGCCTCTCCCTGTCTCCGGGTAAATGA
```

4858_P08 (PGT-123) gamma heavy chain variable region nucleotide sequence:

(SEQ ID NO: 166)
```
CAGCTGCACCTGCAGGAGTCGGGCCCAGGGCTGGTGAAGCCTCCGGA

GACCCTGTCCCTCACGTGTAGTGTGTCTGGCGCCTCCATCAATGATGCC

TATTGGAGTTGGATTCGGCAGTCCCCAGGGAAGCGGCCTGAGTGGGTT

GGATATGTCCATCACAGCGGTGACACAAATTATAATCCCTCACTCAAG

AGGCGCGTCACGTTTTCATTAGACACGGCCAAGAATGAAGTGTCCCTG

AAATTAGTAGACCTGACCGCTGCGGACTCGGCCACATATTTTTGTGCG

CGAGCACTTCACGGGAAGAGGATTTATGGGATAGTTGCCCTCGGAGAG

TTGTTCACCTACTTCTACATGGACGTCTGGGGCAAGGGGACTGCGGTC

ACCGTCTCCTCA
```

4858_P08 (PGT-123) gamma heavy chain amino acid sequence: expressed protein with variable region in bold.

(SEQ ID NO: 167)
MKHLWIFLLLVATPRWVESQLHLQESGPGLVKPPETLSLTCSVSGASI

NDAYWSWIRQSPGKRPEWVGYVHHSGDTNYNPSLKRRVTFSLDTAK

NEVSLKLVDLTAADSATYFCARALHGKRIYGIVALGELFTYFYMDVW
GKGTAVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPS
NTKVDKRVEPKSCDKTHTCPPCPAPELLGGPSVFLFPPKPKDTLMISRTP
EVTCVVVDVSHEDPEVKFNWYVDGVEVHNAKTKPREEQYNSTYRVVSVLT
VLHQDWLNGKEYKCKVSNKALPAPIEKTISKAKGQPREPQVYTLPPSREE
MTKNQVSLTCLVKGFYPSDIAVEWESNGQPENNYKTTPPVLDSDGSFFLY
SKLTVDKSRWQQGNVFSCSVMHEALHNHYTQKSLSLSPGK

4858_P08 (PGT-123) gamma heavy chain variable region amino acid sequence: (Kabat CDRs underlined, Chothia CDRs in bold italics)

(SEQ ID NO: 168)
QLHLQESGPGLVKPPETLSLTCSVS*GASIND*AYWSWIRQSPGKRPEWVG
*YVHHSGDTN*YNPSLKRRVTFSLDTAKNEVSLKLVDLTAADSATYFCAR
*ALHGKRIYGIVALGELFTYFYMDV*WGKGTAVTVSS

4858_P08 (PGT-123) gamma heavy chain Kabat CDRs:

```
CDR 1:   DAYWS                          (SEQ ID NO: 169)
CDR 2:   YVHHSGDTNYNPSLKR               (SEQ ID NO: 170)
CDR 3:   ALHGKRIYGIVALGELFTYFYMDV       (SEQ ID NO: 171)
```

4858_P08 (PGT-123) gamma heavy chain Chothia CDRs:

```
CDR 1:
         GASIND                         (SEQ ID NO: 172)

CDR 2:
         YVHHSGDTN                      (SEQ ID NO: 173)

CDR 3:
         ALHGKRIYGIVALGELFTYFYMDV       (SEQ ID NO: 171)
```

4858_P08 (PGT-123) lambda light chain nucleotide sequence: coding sequence (variable region in bold)

(SEQ ID NO: 174)
ATGGCCTGGACCGTTCTCCTCCTCGGCCTCCTCTCTCACTGCACAGGCT
CTCTGGCC**TCCTCTATGTCCGTGTCCCCGGGGGAGACGGCCAAGATCTC
CTGTGGAAAAGAGAGCATTGGTAGCAGAGCTGTGCAATGGTATCAGCAG
AAGCCAGGCCAGCCCCCCTCATTGATTATCTATAATAATCAGGACCGCC
CCGCAGGGGTCCCTGAGCGATTCTCTGCCTCCCCTGACTTCCGTCCTGG
GACCACGGCCACCCTGACCATCACCAATGTCGACGCCGAGGATGAGGCC
GACTATTACTGTCATATATATGATGCTAGAGGTGGCACCAATTGGGTCT
TCGACAGAGGGACCACACTGACCGTCTTA**GGTCAGCCCAAGGCTGCCCC
CTCGGTCACTCTGTTCCCGCCCTCCTCTGAGGAGCTTCAAGCCAACAAG
GCCACACTGGTGTGTCTCATAAGTGACTTCTACCCGGGAGCCGTGACAG
TGGCCTGGAAGGCAGATAGCAGCCCCGTCAAGGCGGGAGTGGAGACCAC

CACACCCTCCAAACAAAGCAACAACAAGTACGCGGCCAGCAGCTACCTG
AGCCTGACGCCTGAGCAGTGGAAGTCCCACAAAAGCTACAGCTGCCAGG
TCACGCATGAAGGGAGCACCGTGGAGAAGACAGTGGCCCCTACAGAATG
TTCATAG

4858_P08 (PGT-123) lambda light chain variable region nucleotide sequence:

(SEQ ID NO: 175)
TCCTCTATGTCCGTGTCCCCGGGGGAGACGGCCAAGATCTCCTGTGGA
AAAGAGAGCATTGGTAGCAGAGCTGTGCAATGGTATCAGCAGAAGCCA
GGCCAGCCCCCCTCATTGATTATCTATAATAATCAGGACCGCCCCGCA
GGGGTCCCTGAGCGATTCTCTGCCTCCCCTGACTTCCGTCCTGGGACC
ACGGCCACCCTGACCATCACCAATGTCGACGCCGAGGATGAGGCCGAC
TATTACTGTCATATATATGATGCTAGAGGTGGCACCAATTGGGTCTTC
GACAGAGGGACCACACTGACCGTCTTA

4858_P08 (PGT-123) lambda light chain amino acid sequence: expressed protein with variable region in bold.

(SEQ ID NO: 176)
MAWTVLLLGLLSHCTGSLAS**SMSVSPGETAKISCGKESIGSRAVQWYQ
QKPGQPPSLIIYNNQDRPAGVPERFSASPDFRPGTTATLTITNVDAED
EADYYCHIYDARGGTNWVFDRGTTLTVL**GQPKAAPSVTLFPPSSEELQ
ANKATLVCLISDFYPGAVTVAWKADSSPVKAGVETTTPSKQSNNKYAA
SSYLSLTPEQWKSHKSYSCQVTHEGSTVEKTVAPTECS

4858_P08 (PGT-123) lambda light chain variable region amino acid sequence: (Kabat CDRs underlined, Chothia CDRs in bold italics)

(SEQ ID NO: 177)
SSMSVSPGETAKISC*GKESIGSRAVQ*WYQQKPGQPPSLITY NNQDRPA
GVPERFSASPDFRPGTTATLTITNVDAEDEADYY*CHIYDARGGTNWV*
FDRGTTLTVL

4858_P08 (PGT-123) lambda light chain Kabat CDRs:

```
CDR 1:
         GKESIGSRAVQ                    (SEQ ID NO: 178)

CDR 2:
         NNQDRPA                        (SEQ ID NO: 179)

CDR 3:
         HIYDARGGTNWV                   (SEQ ID NO: 180)
```

4858_P08 (PGT-123) lambda light chain Chothia CDRs:

CDR 1:
(SEQ ID NO: 178)
GKESIGSRAVQ

CDR 2:
(SEQ ID NO: 179)
NNQDRPA

CDR 3:
(SEQ ID NO: 180)
HIYDARGGTNWV

5123_A06 (PGT-125) gamma heavy chain nucleotide sequence: coding sequence (variable region in bold)

(SEQ ID NO: 181)
ATGAAACACCTGTGGTTCTTCTTCCTGCTGGTGGCGGCTCCCAGATGCG
TCCTGTCC**CAGTCGCAGCTGCAGGAGTCGGGCCCACGACTGGTGGAGGC
CTCGGAGACCCTGTCACTCACGTGCAATGTGTCCGGCGAGTCCACTGGT
GCCTGTACTTATTTCTGGGGCTGGGTCCGGCAGGCCCCAGGGAAGGGGC
TGGAGTGGATCGGGAGTTTGTCCCATTGTCAGAGTTTCTGGGGTTCCGG
TTGGACCTTCCACAACCCGTCTCTCAAGAGTCGACTCACGATTTCACTC
GACACGCCCAAGAATCAGGTCTTCCTCAAGCTCACTTCTCTGACTGCCG
CGGACACGGCCACTTACTACTGTGCGCGATTCGACGGCGAAGTCTTGGT
CTATAATCATTGGCCAAAGCCGGCCTGGGTGGACCTCTGGGGCCGCGGA
ATACCGGTCACCGTCTCCTCA**GCCTCCACCAAGGGCCCATCGGTCTTCC
CCCTGGCACCCTCCTCCAAGAGCACCTCTGGGGGCACAGCGGCCCTGGG
CTGCCTGGTCAAGGACTACTTCCCCGAACCGGTGACGGTGTCGTGGAAC
TCAGGCGCCCTGACCAGCGGCGTGCACACCTTCCCGGCTGTCCTACAGT
CCTCAGGACTCTACTCCCTCAGCAGCGTGGTGACCGTGCCCTCCAGCAG
CTTGGGCACCCAGACCTACATCTGCAACGTGAATCACAAGCCCAGCAAC
ACCAAGGTGGACAAGAGAGTTGAGCCCAAATCTTGTGACAAAACTCACA
CATGCCCACCGTGCCCAGCACCTGAACTCCTGGGGGGACCGTCAGTCTT
CCTCTTCCCCCCAAAACCCAAGGACACCCTCATGATCTCCCGGACCCCT
GAGGTCACATGCGTGGTGGTGGACGTGAGCCACGAAGACCCTGAGGTCA
AGTTCAACTGGTACGTGGACGGCGTGGAGGTGCATAATGCCAAGACAAA
GCCGCGGGAGGAGCAGTACAACAGCACGTACCGTGTGGTCAGCGTCCTC
ACCGTCCTGCACCAGGACTGGCTGAATGGCAAGGAGTACAAGTGCAAGG
TCTCCAACAAAGCCCTCCCAGCCCCCATCGAGAAAACCATCTCCAAAGC
CAAAGGGCAGCCCCGAGAACCACAGGTGTACACCCTGCCCCCATCCCGG
GAGGAGATGACCAAGAACCAGGTCAGCCTGACCTGCCTGGTCAAAGGCT
TCTATCCCAGCGACATCGCCGTGGAGTGGGAGAGCAATGGGCAGCCGGA
GAACAACTACAAGACCACGCCTCCCGTGCTGGACTCCGACGGCTCCTTC
TTCCTCTATAGCAAGCTCACCGTGGACAAGAGCAGGTGGCAGCAGGGGA
ACGTCTTCTCATGCTCCGTGATGCATGAGGCTCTGCACAACCACTACAC
GCAGAAGAGCCTCTCCCTGTCTCCGGGTAAATGA

5123_A06 (PGT-125) gamma heavy chain variable region nucleotide sequence:

(SEQ ID NO: 182)
CAGTCGCAGCTGCAGGAGTCGGGCCCACGACTGGTGGAGGCCTCGGAG
ACCCTGTCACTCACGTGCAATGTGTCCGGCGAGTCCACTGGTGCCTGT
ACTTATTTCTGGGGCTGGGTCCGGCAGGCCCCAGGGAAGGGGCTGGAG
TGGATCGGGAGTTTGTCCCATTGTCAGAGTTTCTGGGGTTCCGGTTGG
ACCTTCCACAACCCGTCTCTCAAGAGTCGACTCACGATTTCACTCGAC
ACGCCCAAGAATCAGGTCTTCCTCAAGCTCACTTCTCTGACTGCCGCG
GACACGGCCACTTACTACTGTGCGCGATTCGACGGCGAAGTCTTGGTC
TATAATCATTGGCCAAAGCCGGCCTGGGTGGACCTCTGGGGCCGCGGA
ATACCGGTCACCGTCTCCTCA

5123_A06 (PGT-125) gamma heavy chain amino acid sequence: expressed protein with variable region in bold.

(SEQ ID NO: 183)
**MKHLWFFFLLVAAPRCVLSQSQLQESGPRLVEASETLSLTCNVSGESTGA
CTYFWGWVRQAPGKGLEWIGSLSHCQSFWGSGWTFHNPSLKSRLTISLDT
PKNQVFLKLTSLTAADTATYYCARFDGEVLVYNHWPKPAWVDLWGRGIPV
TVSS**ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDK
RVEPKSCDKTHTCPPCPAPELLGGPSVFLFPPKPKDTLMISRTPEVTCVV
VDVSHEDPEVKFNWYVDGVEVHNAKTKPREEQYNSTYRVVSVLTVLHQDW
LNGKEYKCKVSNKALPAPIEKTISKAKGQPREPQVYTLPPSREEMTKNQV
SLTCLVKGFYPSDIAVEWESNGQPENNYKTTPPVLDSDGSFFLYSKLTVD
KSRWQQGNVFSCSVMHEALHNHYTQKSLSLSPGK

5123_A06 (PGT-125) gamma heavy chain variable region amino acid sequence: (Kabat CDRs underlined, Chothia CDRs in bold italics)

(SEQ ID NO: 184)
QSQLQESGPRLVEASETLSLTCNVS*GESTGACT*YFWGWVRQAPGKGLEWI
G*S LSHCQSFWGSGWTFHNPSLKS*RLTISLDTPKNQVFLKLTSLTAADTA
TYYCAR*FDGEVLVYNHWPKPAWVDL*WGRGIPVTVSS

5123_A06 (PGT-125) gamma heavy chain Kabat CDRs:

CDR 1:
(SEQ ID NO: 185)
ACTYFWG

CDR 2:
(SEQ ID NO: 186)
SLSHCQSFWGSGWTFHNPSLKS

CDR 3:
(SEQ ID NO: 187)
FDGEVLVYNHWPKPAWVDL

5123_A06 (PGT-125) gamma heavy chain Chothia CDRs:

CDR 1:
(SEQ ID NO: 188)
GESTGACT

-continued

CDR 2:
(SEQ ID NO: 189)
SLSHCQSFWGSGWTF

CDR 3:
(SEQ ID NO: 187)
FDGEVLVYNHWPKPAWVDL

5123_A06 (PGT-125) lambda light chain nucleotide sequence: coding sequence (variable region in bold)

(SEQ ID NO: 190)
ATGGCCTGGGCTCTGCTCCTCCTCACCCTCCTCACTCAGGGCACAGGGG
CCTGGGCC**CAGTCTGCCCTGACTCAGCCTCCCTCCGCGTCCGGGTCTCC
TGGACAGTCAATCACCATCTCCTGCAATGGAACCGCCACTAACTTTGTC
TCCTGGTACCAACAATTCCCAGACAAGGCCCCCAAACTCATCATTTTTG
GGGTCGATAAGCGCCCCCCCGGTGTCCCCGATCGTTTCTCTGGCTCCCG
GTCTGGCACGACGGCCTCCCTTACCGTCTCCCGACTCCAGACTGACGAT
GAGGCTGTCTATTATTGCGGTTCACTTGTCGGCAACTGGGATGTGATTT
TCGGCGGAGGGACCACCTTGACCGTCCTAGGT**CAGCCCAAGGCTGCCCC
CTCGGTCACTCTGTTCCCGCCCTCCTCTGAGGAGCTTCAAGCCAACAAG
GCCACACTGGTGTGTCTCATAAGTGACTTCTACCCGGGAGCCGTGACAG
TGGCCTGGAAGGCAGATAGCAGCCCCGTCAAGGCGGGAGTGGAGACCAC
CACACCCTCCAAACAAAGCAACAACAAGTACGCGGCCAGCAGCTACCTG
AGCCTGACGCCTGAGCAGTGGAAGTCCCACAAAAGCTACAGCTGCCAGG
TCACGCATGAAGGGAGCACCGTGGAGAAGACAGTGGCCCCTACAGAATG
TTCATAG

5123_A06 (PGT-125) lambda light chain variable region nucleotide sequence:

(SEQ ID NO: 191)
CAGTCTGCCCTGACTCAGCCTCCCTCCGCGTCCGGGTCTCCTGGACAGT
CAATCACCATCTCCTGCAATGGAACCGCCACTAACTTTGTCTCCTGGTA
CCAACAATTCCCAGACAAGGCCCCCAAACTCATCATTTTTGGGGTCGAT
AAGCGCCCCCCCGGTGTCCCCGATCGTTTCTCTGGCTCCCGGTCTGGCA
CGACGGCCTCCCTTACCGTCTCCCGACTCCAGACTGACGATGAGGCTGT
CTATTATTGCGGTTCACTTGTCGGCAACTGGGATGTGATTTTCGGCGGA
GGGACCACCTTGACCGTCCTA

5123_A06 (PGT-125) lambda light chain amino acid sequence: expressed protein with variable region in bold.

(SEQ ID NO: 192)
MAWALLLLTLLTQGTGAWA**QSALTQPPSASGSPGQSITISCNGTATNF
VSWYQQFPDKAPKLIIFGVDKRPPGVPDRFSGSRSGTTASLTVSRLQT
DDEAVYYCGSLVGNWDVIFGGGTTLTVL**GQPKAAPSVTLFPPSSEELQ
ANKATLVCLISDFYPGAVTVAWKADSSPVKAGVETTTPSKQSNNKYAA
SSYLSLTPEQWKSHKSYSCQVTHEGSTVEKTVAPTECS

5123_A06 (PGT-125) lambda light chain variable region amino acid sequence: (Kabat CDRs underlined, Chothia CDRs in bold italics)

(SEQ ID NO: 193)
QSALTQPPSASGSPGQSITISC*NGTATNFVS*WYQQFPDKAPKLII
F *GVDKRPP*GVPDRFSGSRSGTTASLTVSRLQTDDEAVYYC
*GSLVGNWDVI*FGGGTTLTVL

5123_A06 (PGT-125) lambda light chain Kabat CDRs:

CDR 1:
(SEQ ID NO: 194)
NGTATNFVS

CDR 2:
(SEQ ID NO: 195)
GVDKRPP

CDR 3:
(SEQ ID NO: 196)
GSLVGNWDVI

5123_A06 (PGT-125) lambda light chain Chothia CDRs:

CDR 1:
(SEQ ID NO: 194)
NGTATNFVS

CDR 2:
(SEQ ID NO: 195)
GVDKRPP

CDR 3:
(SEQ ID NO: 196)
GSLVGNWDVI

5141_B17 (PGT-126) gamma heavy chain nucleotide sequence: coding sequence (variable region in bold)

(SEQ ID NO: 197)
ATGAAACACCTGTGGTTCTTCCTCCTGCTGGTGGCGGCTCCCAGATGG
GTCCTGTCC**CAGCCGCAGCTGCAGGAGTCGGGGCCAGGACTGGTGGAG
GCTTCGGAGACCCTGTCCCTCACCTGCACTGTGTCCGGCGACTCCACT
GCTGCTTGTGACTATTTCTGGGGCTGGGTCCGGCAGCCCCCAGGGAAG
GGCCTGGAGTGGATTGGGGGTTTGTCACATTGTGCAGGTTACTACAAT
ACTGGCTGGACCTACCACAACCCGTCTCTCAAGAGTCGGCTCACGATT
TCACTCGACACCCCCAAGAATCAGGTCTTCCTGAAGTTAAATTCTGTG
ACCGCCGCGGACACGGCCATTTACTACTGTGCGCGATTCGACGGCGAA
GTTTTGGTGTACCACGATTGGCCAAAGCCGGCCTGGGTCGACCTCTGG
GGCCGGGGAACTTTGGTCACCGTCTCCTCA**GCCTCCACCAAGGGCCCA
TCGGTCTTCCCCCTGGCACCCTCCTCCAAGAGCACCTCTGGGGGCACA
GCGGCCCTGGGCTGCCTGGTCAAGGACTACTTCCCCGAACCGGTGACG
GTGTCGTGGAACTCAGGCGCCCTGACCAGCGGCGTGCACACCTTCCCG
GCTGTCCTACAGTCCTCAGGACTCTACTCCCTCAGCAGCGTGGTGACC
GTGCCCTCCAGCAGCTTGGGCACCCAGACCTACATCTGCAACGTGAAT
CACAAGCCCAGCAACACCAAGGTGGACAAGAGAGTTGAGCCCAAATCT

-continued
TGTGACAAAACTCACACATGCCCACCGTGCCCAGCACCTGAACTCCTG

GGGGGACCGTCAGTCTTCCTCTTCCCCCCAAAACCCAAGGACACCCTC

ATGATCTCCCGGACCCCTGAGGTCACATGCGTGGTGGTGGACGTGAGC

CACGAAGACCCTGAGGTCAAGTTCAACTGGTACGTGGACGGCGTGGAG

GTGCATAATGCCAAGACAAAGCCGCGGGAGGAGCAGTACAACAGCACG

TACCGTGTGGTCAGCGTCCTCACCGTCCTGCACCAGGACTGGCTGAAT

GGCAAGGAGTACAAGTGCAAGGTCTCCAACAAAGCCCTCCCAGCCCCC

ATCGAGAAAACCATCTCCAAAGCCAAAGGGCAGCCCCGAGAACCACAG

GTGTACACCCTGCCCCCATCCCGGGAGGAGATGACCAAGAACCAGGTC

AGCCTGACCTGCCTGGTCAAAGGCTTCTATCCCAGCGACATCGCCGTG

GAGTGGGAGAGCAATGGGCAGCCGGAGAACAACTACAAGACCACGCCT

CCCGTGCTGGACTCCGACGGCTCCTTCTTCCTCTATAGCAAGCTCACC

GTGGACAAGAGCAGGTGGCAGCAGGGGAACGTCTTCTCATGCTCCGTG

ATGCATGAGGCTCTGCACAACCACTACACGCAGAAGAGCCTCTCCCTG

TCTCCGGGTAAATGA

5141_B17 (PGT-126) gamma heavy chain variable region nucleotide sequence:

(SEQ ID NO: 198)
CAGCCGCAGCTGCAGGAGTCGGGGCCAGGACTGGTGGAGGCTTCGGAG

ACCCTGTCCCTCACCTGCACTGTGTCCGGCGACTCCACTGCTGCTTGT

GACTATTTCTGGGGCTGGGTCCGGCAGCCCCCAGGGAAGGGCCTGGAG

TGGATTGGGGGTTTGTCACATTGTGCAGGTTACTACAATACTGGCTGG

ACCTACCACAACCCGTCTCTCAAGAGTCGGCTCACGATTTCACTCGAC

ACCCCCAAGAATCAGGTCTTCCTGAAGTTAAATTCTGTGACCGCCGCG

GACACGGCCATTTACTACTGTGCGCGATTCGACGGCGAAGTTTTGGTG

TACCACGATTGGCCAAAGCCGGCCTGGGTCGACCTCTGGGGCCGGGGA

ACTTTGGTCACCGTCTCCTCA

5141_B17 (PGT-126) gamma heavy chain amino acid sequence: expressed protein with variable region in bold.

(SEQ ID NO: 199)
MKHLWFFLLLVAAPRWVLSQPQLQESGPGLVEASETLSLTCTVSGDST

AACDYFWGWVRQPPGKGLEWIGGLSHCAGYYNTGWTYHNPSLKSRLTI

SLDTPKNQVFLKLNSVTAADTAIYYCARFDGEVLVYHDWPKPAWVDLW

GRGTLVTVSSASTKGPSVFPLAPSSKSTSGGTAALGCLVKDYFPEPVT

VSWNSGALTSGVHTFPAVLQSSGLYSLSSVVTVPSSSLGTQTYICNVN

HKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYNST

YRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSL

SPGK

5141_B17 (PGT-126) gamma heavy chain variable region amino acid sequence: (Kabat CDRs underlined, Chothia CDRs in bold italics)

(SEQ ID NO: 200)
QPQLQESGPGLVEASETLSLTCTVS*GDSTAAC*<u>DYFWG</u>WVRQPPGKGLEW

IG*GLSHCAGYYNTGWTY*<u>HNPSLKS</u>RLTISLDTPKNQVFLKLNSVTAAD

TAIYYCAR*FDGEVLVYHDWPKPAWVDL*WGRGTLVTVSS

5141_B17 (PGT-126) gamma heavy chain Kabat CDRs:

CDR 1:
(SEQ ID NO: 201)
ACDYFWG

CDR 2:
(SEQ ID NO: 202)
GLSHCAGYYNTGWTYHNPSLKS

CDR 3:
(SEQ ID NO: 203)
FDGEVLVYHDWPKPAWVDL

5141_B17 (PGT-126) gamma heavy chain Chothia CDRs:

CDR 1:
(SEQ ID NO: 204)
GDSTAACD

CDR 2:
(SEQ ID NO: 205)
GLSHCAGYYNTGWTY

CDR 3:
(SEQ ID NO: 203)
FDGEVLVYHDWPKPAWVDL

5141_B17 (PGT-126) lambda light chain nucleotide sequence: coding sequence (variable region in bold)

(SEQ ID NO: 206)
ATGGCCTGGGCTCTGCTCCTCCTCACCCTCCTCACTCAGGGCACAGG

GGCCTGGGCCCAGTCTGCCCTGACTCAGCCTCCCTCCGCGTCCGGGT

CTCCTGGACAGTCAATCTCCATCTCCTGCACTGGAACCAGCAATAGG

TTTGTCTCCTGGTACCAGCAACACCCAGGCAAGGCCCCCAAAACTCGT

CATTTATGGGTCAATAAGCGCCCCTCAGGTGTCCCTGATCGTTTTT

CTGGCTCCAAGTCTGGCAACACGGCCTCCCTGACCGTCTCTGGGCTC

CAGACTGACGATGAGGCTGTCTATTACTGCAGCTCACTTGTAGGCAA

CTGGGATGTGATTTTCGGCGGAGGGACCAAGTTGACCGTCCTGGGTC

AGCCCAAGGCTGCCCCCTCGGTCACTCTGTTCCCGCCCTCCTCTGAG

GAGCTTCAAGCCAACAAGGCCACACTGGTGTGTCTCATAAGTGACTT

CTACCCGGGAGCCGTGACAGTGGCCTGGAAGGCAGATAGCAGCCCCG

TCAAGGCGGGAGTGGAGACCACCACACCCTCCAAACAAAGCAACAAC

AAGTACGCGGCCAGCAGCTACCTGAGCCTGACGCCTGAGCAGTGGAA

GTCCCACAAAAGCTACAGCTGCCAGGTCACGCATGAAGGGAGCACCG

TGGAGAAGACAGTGGCCCCTACAGAATGTTCATAG

5141_B17 (PGT-126) lambda light chain variable region nucleotide sequence:

(SEQ ID NO: 207)
CAGTCTGCCCTGACTCAGCCTCCCTCCGCGTCCGGGTCTCCTGGACAGT
CAATCTCCATCTCCTGCACTGGAACCAGCAATAGGTTTGTCTCCTGGTA
CCAGCAACACCCAGGCAAGGCCCCCAAACTCGTCATTTATGGGGTCAAT
AAGCGCCCCTCAGGTGTCCCTGATCGTTTTTCTGGCTCCAAGTCTGGCA
ACACGGCCTCCCTGACCGTCTCTGGGCTCCAGACTGACGATGAGGCTGT
CTATTACTGCAGCTCACTTGTAGGCAACTGGGATGTGATTTTCGGCGGA
GGGACCAAGTTGACCGTCCTG

5141_B17 (PGT-126) lambda light chain amino acid sequence: expressed protein with variable region in bold.

(SEQ ID NO: 208)
MAWALLLLTLLTQGTGAWAQSALTQPPSASGSPGQSISISCTGTSNRFV
SWYQQHPGKAPKLVIYGVNKRPSGVPDRFSGSKSGNTASLTVSGLQTDD
EAVYYCSSLVGNWDVIFGGGTKLTVLGQPKAAPSVTLFPPSSEELQANK
ATLVCLISDFYPGAVTVAWKADSSPVKAGVETTTPSKQSNNKYAASSYL
SLTPEQWKSHKSYSCQVTHEGSTVEKTVAPTECS

5141_B17 (PGT-126) lambda light chain variable region amino acid sequence: (Kabat CDRs underlined, Chothia CDRs in bold italics)

(SEQ ID NO: 209)
QSALTQPPSASGSPGQSISISC*TGTSNRFVS*WYQQHPGKAPKLVIY
*GVNKRPS*GVPDRFSGSKSGNTASLTVSGLQTDDEAVYYC *SSLVGNWDVI*
FGGGTKLTVL

5141_B17 (PGT-126) lambda light chain Kabat CDRs:

```
CDR 1:
                                    (SEQ ID NO: 210)
TGTSNRFVS
CDR 2:
                                    (SEQ ID NO: 211)
GVNKRPS
CDR 3:
                                    (SEQ ID NO: 212)
SSLVGNWDVI
```

5141_B17 (PGT-126) lambda light chain Chothia CDRs:

```
                                    (SEQ ID NO: 210)
CDR 1: TGTSNRFVS (SEQ ID NO: 211)
CDR 2: GVNKRPS (SEQ ID NO: 212)
CDR 3: SSLVGNWDVI
```

5147_N06 (PGT-130) gamma heavy chain nucleotide sequence: coding sequence (variable region in bold)

(SEQ ID NO: 213)
ATGAAACACCTGTGGTTCTTCCTCCTGCTGGTGGCGGCTCCCAGATGG
GTCCTGTCCCAGGTGCAGCTGCAGGAGTCGGGCCCAGGACTGGTG
AAGCCTGCGGAGACCCTGTCCCTCACCTGCAGTGTCTCTGGAGAA
TCTATCAATACTGGTCATTACTACTGGGGCTGGGTCCGTCAGGTC
CCAGGGAAGGGACTTGAGTGGATAGGTCATATCCATTATACGACG
GCTGTCCTGCACAACCCGTCCCTCAAGAGTCGACTCACCATCAAA
ATTTACACGTTGAGAAACCAGATTACCCTGAGGCTCAGTAATGTG
ACGGCCGCGGACACGGCCGTCTATCACTGCGTACGATCCGGCGGC
GACATCTTATATTATTATGAGTGGCAAAAGCCGCACTGGTTCTCTC
CCTGGGGCCCGGGAATCCACGTCACCGTCTCGAGCGCCTCCACCA
AGGGCCCATCGGTCTTCCCCCTGGCACCCTCCTCCAAGAGCACCTCTG
GGGGCACAGCGGCCCTGGGCTGCCTGGTCAAGGACTACTTCCCCGAAC
CGGTGACGGTGTCGTGGAACTCAGGCGCCCTGACCAGCGGCGTGCACA
CCTTCCCGGCTGTCCTACAGTCCTCAGGACTCTACTCCCTCAGCAGCGT
GGTGACCGTGCCCTCCAGCAGCTTGGGCACCCAGACCTACATCTGCAA
CGTGAATCACAAGCCCAGCAACACCAAGGTGGACAAGAGAGTTGAGC
CCAAATCTTGTGACAAAACTCACACATGCCCACCGTGCCCAGCACCTG
AACTCCTGGGGGGACCGTCAGTCTTCCTCTTCCCCCCAAAACCCAAGG
ACACCCTCATGATCTCCCGGACCCCTGAGGTCACATGCGTGGTGGTGG
ACGTGAGCCACGAAGACCCTGAGGTCAAGTTCAACTGGTACGTGGACG
GCGTGGAGGTGCATAATGCCAAGACAAAGCCGCGGGAGGAGCAGTAC
AACAGCACGTACCGTGTGGTCAGCGTCCTCACCGTCCTGCACCAGGAC
TGGCTGAATGGCAAGGAGTACAAGTGCAAGGTCTCCAACAAAGCCCTC
CCAGCCCCCATCGAGAAAACCATCTCCAAAGCCAAAGGGCAGCCCCG
AGAACCACAGGTGTACACCCTGCCCCCATCCCGGGAGGAGATGACCA
AGAACCAGGTCAGCCTGACCTGCCTGGTCAAAGGCTTCTATCCCAGCG
ACATCGCCGTGGAGTGGGAGAGCAATGGGCAGCCGGAGAACAACTAC
AAGACCACGCCTCCCGTGCTGGACTCCGACGGCTCCTTCTTCCTCTATA
GCAAGCTCACCGTGGACAAGAGCAGGTGGCAGCAGGGGAACGTCTTC
TCATGCTCCGTGATGCATGAGGCTCTGCACAACCACTACACGCAGAAG
AGCCTCTCCCTGTCTCCGGGTAAATGA

5147_N06 (PGT-130) gamma heavy chain variable region nucleotide sequence:

(SEQ ID NO: 214)
CAGGTGCAGCTGCAGGAGTCGGGCCCAGGACTGGTGAAGCCTGCGGA
GACCCTGTCCCTCACCTGCAGTGTCTCTGGAGAATCTATCAATACTGGT
CATTACTACTGGGGCTGGGTCCGTCAGGTCCCAGGGAAGGGACTTGAG
TGGATAGGTCATATCCATTATACGACGGCTGTCCTGCACAACCCGTCC
CTCAAGAGTCGACTCACCATCAAAATTTACACGTTGAGAAACCAGATT
ACCCTGAGGCTCAGTAATGTGACGGCCGCGGACACGGCCGTCTATCAC
TGCGTACGATCCGGCGGCGACATCTTATATTATTATGAGTGGCAAAAG
CCGCACTGGTTCTCTCCCTGGGGCCCGGGAATCCACGTCACCGTCTCG
AGC

5147_N06 (PGT-130) gamma heavy chain amino acid sequence: expressed protein with variable region in bold.

(SEQ ID NO: 215)
MKHLWFFLLLVAAPRWVLSQVQLQESGPGLVKPAETLSLTCSVSGES
INTGHYYWGWVRQVPGKGLEWIGHIHYTTAVLHNPSLKSRLTIKIYT
LRNQITLRLSNVTAADTAVYHCVRSGGDILYYYEWQKPHWFSPWGP
GIHVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNT
KVDKRVEPKSCDKTHTCPPCPAPELLGGPSVFLFPPKPKDTLMISRTPEV
TCVVVDVSHEDPEVKFNWYVDGVEVHNAKTKPREEQYNSTYRVVSVLTVL
HQDWLNGKEYKCKVSNKALPAPIEKTISKAKGQPREPQVYTLPPSREEMT
KNQVSLTCLVKGFYPSDIAVEWESNGQPENNYKTTPPVLDSDGSFFLYSK
LTVDKSRWQQGNVFSCSVMHEALHNHYTQKSLSLSPGK

5147_N06 (PGT-130) gamma heavy chain variable region amino acid sequence: (Kabat CDRs underlined, Chothia CDRs in bold italics)

(SEQ ID NO: 216)
QVQLQESGPGLVKPAETLSLTCSVS*GESINTGH*YYWGWVRQVPGKGL
EWIG*HIHYTTAVL*HNPSLKSRLTIKIYTLRNQITLRLSNVTAADTAV
YHCVR*SGGDILYYYEWQKPHWFSP*WGPGIHVTVSS

5147_N06 (PGT-130) gamma heavy chain Kabat CDRs:

(SEQ ID NO: 217)
CDR 1: TGHYYWG (SEQ ID NO: 218)
CDR 2: HIHYTTAVLHNPSLKS (SEQ ID NO: 219)
CDR 3: SGGDILYYYEWQKPHWFSP

5147_N06 (PGT-130) gamma heavy chain Chothia CDRs:

(SEQ ID NO: 220)
CDR 1: GESINTGH (SEQ ID NO: 221)
CDR 2: HIHYTTAVL (SEQ ID NO: 219)
CDR 3: SGGDILYYYEWQKPHWFSP

5147_N06 (PGT-130) lambda light chain nucleotide sequence: coding sequence (variable region in bold)

(SEQ ID NO: 222)
ATGGCCTGGGCTCTGCTCCTCCTCACCCTCCTCACTCAGGGCACAGGGT
CCTGGGCC**CAGTCTGCCCTGACTCAGCCTCCCTCCGCGTCCGGGTC
TCTTGGACAGTCAGTCACCATCTCCTGCAATGGAACCAGCAGTGA
CATTGGCGGTTGGAATTTTGTCTCCTGGTATCAACAGTTCCCGGG
CAGAGCCCCCAGACTCATTATTTTTGAGGTCAATAAGCGGCCCTC
AGGGGTCCCTGGTCGCTTCTCTGGCTCCAAGTCGGGCAATTCGGC
CTCCCTGACCGTCTCTGGGCTCCAGTCTGACGATGAGGGTCAATA
TTTCTGCAGTTCACTTTTCGGCAGGTGGGATGTTGTTTTTGGCGGG
GGGACCAAGCTGACCGTCCTA**GGTCAGCCCAAGGCTGCCCCTCGGT
CACTCTGTTCCCGCCCTCCTCTGAGGAGCTTCAAGCCAACAAGGCCAC
ACTGGTGTGTCTCATAAGTGACTTCTACCCGGGAGCCGTGACAGTGGC
CTGGAAGGCAGATAGCAGCCCCGTCAAGGCGGGAGTGGAGACCACCA
CACCCTCCAAACAAAGCAACAACAAGTACGCGGCCAGCAGCTACCTG
AGCCTGACGCCTGAGCAGTGGAAGTCCCACAAAAGCTACAGCTGCCA
GGTCACGCATGAAGGGAGCACCGTGGAGAAGACAGTGGCCCCTACAG
AATGTTCATAG

5147_N06 (PGT-130) lambda light chain variable region nucleotide sequence:

(SEQ ID NO: 223)
CAGTCTGCCCTGACTCAGCCTCCCTCCGCGTCCGGGTCTCTTGGACAGT
CAGTCACCATCTCCTGCAATGGAACCAGCAGTGACATTGGCGGTTGGA
ATTTTGTCTCCTGGTATCAACAGTTCCCGGGCAGAGCCCCCAGACTCAT
TATTTTTGAGGTCAATAAGCGGCCCTCAGGGGTCCCTGGTCGCTTCTCT
GGCTCCAAGTCGGGCAATTCGGCCTCCCTGACCGTCTCTGGGCTCCAG
TCTGACGATGAGGGTCAATATTTCTGCAGTTCACTTTTCGGCAGGTGGG
ATGTTGTTTTTGGCGGGGGGACCAAGCTGACCGTCCTA

5147_N06 (PGT-130) lambda light chain amino acid sequence: expressed protein with variable region in bold.

(SEQ ID NO: 224)
MAWALLLLTLLTQGTGSWAQSALTQPPSASGSLGQSVTISCNGTSSDI
GGWNFVSWYQQFPGRAPRLIIFEVNKRPSGVPGRFSGSKSGNSASLTV
SGLQSDDEGQYFCSSLFGRWDVVFGGGTKLTVLGQPKAAPSVTLFPPS
SEELQANKATLVCLISDFYPGAVTVAWKADSSPVKAGVETTTPSKQSNNK
YAASSYLSLTPEQWKSHKSYSCQVTHEGSTVEKTVAPTECS

5147_N06 (PGT-130) lambda light chain variable region amino acid sequence: (Kabat CDRs underlined, Chothia CDRs in bold italics)

(SEQ ID NO: 225)
QSALTQPPSASGSLGQSVTISC*NGTSSDIGGWNFVS*WYQQFPGRAPR
LIIF*EVNKRPS*GVPGRFSGSKSGNSASLTVSGLQSDDEGQYFC
*SSLFGRWDVV*FGGGTKLTVL

5147_N06 (PGT-130) lambda light chain Kabat CDRs:

(SEQ ID NO: 226)
CDR 1: NGTSSDIGGWNFVS (SEQ ID NO: 227)
CDR 2: EVNKRPS (SEQ ID NO: 228)
CDR 3: SSLFGRWDVV

5147_N06 (PGT-130) lambda light chain Chothia CDRs:

```
                                     (SEQ ID NO: 226)
        CDR 1: NGTSSDIGGWNFVS
                                     (SEQ ID NO: 227)
        CDR 2: EVNKRPS
                                     (SEQ ID NO: 228)
        CDR 3: SSLFGRWDVV
```

5343_B08 (PGT-135) gamma heavy chain nucleotide sequence: coding sequence (variable region in bold)

```
                                              (SEQ ID NO: 229)
ATGAAACACCTGTGGTTCTTCCTCTTGCTGGTGGCGGCTCCCAGATGGG
TCCTGTCCCAGTTGCAGATGCAGGAGTCGGGCCCAGGACTGGTGA
AGCCTTCGGAGACCCTGTCTCTGAGTTGCACTGTCTCTGGTGACT
CCATAAGGGGTGGCGAGTGGGGCGATAAAGATTATCATTGGGCT
GGGTCCGCCACTCAGCAGGAAAGGGCCTGGAGTGGATTGGGAGT
ATCCATTGGAGGGGACCACCCACTACAAAGAGTCCCTCAGGAGA
AGAGTGAGTATGTCGATCGACACGTCCAGGAATTGGTTCTCCCTG
AGGCTGGCCTCTGTGACCGCCGCGGACACGGCCGTCTACTTTTGT
GCGAGACACCGACATCATGATGTTTTCATGTTGGTCCCTATTGCG
GGCTGGTTCGACGTCTGGGGCCCGGGAGTCCAGGTCACCGTCTCG
AGCGCCTCCACCAAGGGCCCATCGGTCTTCCCCCTGGCACCCTCCTCC
AAGAGCACCTCTGGGGGCACAGCGGCCCTGGGCTGCCTGGTCAAGGA
CTACTTCCCCGAACCGGTGACGGTGTCGTGGAACTCAGGCGCCCTGAC
CAGCGGCGTGCACACCTTCCCGGCTGTCCTACAGTCCTCAGGACTCTA
CTCCCTCAGCAGCGTGGTGACCGTGCCCTCCAGCAGCTTGGGCACCCA
GACCTACATCTGCAACGTGAATCACAAGCCCAGCAACACCAAGGTGG
ACAAGAGAGTTGAGCCCAAATCTTGTGACAAAACTCACACATGCCCAC
CGTGCCCAGCACCTGAACTCCTGGGGGGACCGTCAGTCTTCCTCTTCCC
CCCAAAACCCAAGGACACCCTCATGATCTCCCGGACCCCTGAGGTCAC
ATGCGTGGTGGTGGACGTGAGCCACGAAGACCCTGAGGTCAAGTTCAA
CTGGTACGTGGACGGCGTGGAGGTGCATAATGCCAAGACAAAGCCGC
GGGAGGAGCAGTACAACAGCACGTACCGTGTGGTCAGCGTCCTCACCG
TCCTGCACCAGGACTGGCTGAATGGCAAGGAGTACAAGTGCAAGGTCT
CCAACAAAGCCCTCCCAGCCCCCATCGAGAAAACCATCTCCAAAGCCA
AAGGGCAGCCCCGAGAACCACAGGTGTACACCCTGCCCCCATCCCGG
GAGGAGATGACCAAGAACCAGGTCAGCCTGACCTGCCTGGTCAAAGG
CTTCTATCCCAGCGACATCGCCGTGGAGTGGGAGAGCAATGGGCAGCC
GGAGAACAACTACAAGACCACGCCTCCCGTGCTGGACTCCGACGGCTC
CTTCTTCCTCTATAGCAAGCTCACCGTGGACAAGAGCAGGTGGCAGCA
GGGGAACGTCTTCTCATGCTCCGTGATGCATGAGGCTCTGCACAACCA
CTACACGCAGAAGAGCCTCTCCCTGTCTCCGGGTAAATGA
```

5343_B08 (PGT-135) gamma heavy chain variable region nucleotide sequence:

```
                                              (SEQ ID NO: 230)
CAGTTGCAGATGCAGGAGTCGGGCCCAGGACTGGTGAAGCCTTCGGA
GACCCTGTCTCTGAGTTGCACTGTCTCTGGTGACTCCATAAGGGGTGGC
GAGTGGGGCGATAAAGATTATCATTGGGCTGGGTCCGCCACTCAGCA
GGAAAGGGCCTGGAGTGGATTGGGAGTATCCATTGGAGGGGACCAC
CCACTACAAAGAGTCCCTCAGGAGAAGAGTGAGTATGTCGATCGACAC
GTCCAGGAATTGGTTCTCCCTGAGGCTGGCCTCTGTGACCGCCGCGGA
CACGGCCGTCTACTTTTGTGCGAGACACCGACATCATGATGTTTTCATG
TTGGTCCCTATTGCGGGCTGGTTCGACGTCTGGGGCCCGGGAGTCCAG
GTCACCGTCTCGAGC
```

5343_B08 (PGT-135) gamma heavy chain amino acid sequence: expressed protein with variable region in bold.

```
                                              (SEQ ID NO: 231)
MKHLWFFLLLVAAPRWVLSQLQMQESGPGLVKPSETLSLSCTVSGDS
IRGGEWGDKDYHWGWVRHSAGKGLEWIGSIHWRGTTHYKESLRRR
VSMSIDTSRNWFSLRLASVTAADTAVYFCARHRHHDVFMLVPIAGWF
DVWGPGVQVTVSSASTKGPSVFPLAPSSKSTSGGTAALGCLVKDYFPEPV
TVSWNSGALTSGVHTFPAVLQSSGLYSLSSVVTVPSSSLGTQTYICNVNH
KPSNTKVDKRVEPKSCDKTHTCPPCPAPELLGGPSVFLFPPKPKDTLMIS
RTPEVTCVVVDVSHEDPEVKFNWYVDGVEVHNAKTKPREEQYNSTYRVVS
VLTVLHQDWLNGKEYKCKVSNKALPAPIEKTISKAKGQPREPQVYTLPPS
REEMTKNQVSLTCLVKGFYPSDIAVEWESNGQPENNYKTTPPVLDSDGSF
FLYSKLTVDKSRWQQGNVFSCSVMHEALHNHYTQKSLSLSPGK
```

5343_B08 (PGT-135) gamma heavy chain variable region amino acid sequence:
(Kabat CDRs underlined, Chothia CDRs in bold italics)

```
                                              (SEQ ID NO: 232)
QLQMQESGPGLVKPSETLSLSCTVS*GDSIR**GGEWGDKD*YHWGWVRHS
AGKGLEWIG*SIHWRGTTH*YKESLRRRVSMSIDTSRNWFSLRLASVTA
ADTAVYFCAR*HRHHDVFMLVPIAGWFDV*WGPGVQVTVSS
```

5343_B08 (PGT-135) gamma heavy chain Kabat CDRs:

```
                                     (SEQ ID NO: 233)
        CDR 1: GGEWGDKDYHWG
                                     (SEQ ID NO: 234)
        CDR 2: SIHWRGTTHYKESLRR
                                     (SEQ ID NO: 235)
        CDR 3: HRHHDVFMLVPIAGWFDV
```

5343_B08 (PGT-135) gamma heavy chain Chothia CDRs:

```
                                     (SEQ ID NO: 236)
        CDR 1: GDSIRGGEWGDKD
                                     (SEQ ID NO: 237)
        CDR 2: SIHWRGTTH
```

CDR 3: HRHHDVFMLVPIAGWFDV (SEQ ID NO: 235)

5343_B08 (PGT-135) kappa light chain nucleotide sequence: coding sequence (variable region in bold)

(SEQ ID NO: 238)
ATGGAAACCCCAGCTCAGCTTCTCTTCCTCCTGCTACTCTGGCTCCCAG

ATACCACTGGAGAAATTGTGATGACGCAGTCTCCCGACACCCTGTC

TGTCTCTCCAGGGGAGACAGTCACACTCTCCTGCAGGGCCAGTCA

GAATATTAACAAGAATTTAGCCTGGTACCAATACAAACCTGGCCA

GTCTCCCAGGCTCGTAATTTTTGAAACATATAGCAAGATCGCTGCT

TTCCCTGCCAGGTTCGTTGCCAGTGGTTCTGGGACAGAGTTCACT

CTCACCATCAACAACATGCAGTCTGAAGATGTTGCAGTTTATTACT

GTCAACAATATGAAGAGTGGCCTCGGACGTTCGGGCAAGGGACCA

AGGTGGATATCAAACGTACGGTGGCTGCACCATCTGTCTTCATCTTCC

CGCCATCTGATGAGCAGTTGAAATCTGGAACTGCCTCTGTTGTGTGCCT

GCTGAATAACTTCTATCCCAGAGAGGCCAAAGTACAGTGGAAGGTGG

ATAACGCCCTCCAATCGGGTAACTCCCAGGAGAGTGTCACAGAGCAGG

ACAGCAAGGACAGCACCTACGCCTCAGCAGCACCCTGACGCTGAGC

AAAGCAGACTACGAGAAACACAAAGTCTACGCCTGCGAAGTCACCCA

TCAGGGCCTGAGCTCGCCCGTCACAAAGAGCTTCAACAGGGGAGAGT

GTTAG

5343_B08 (PGT-135) kappa light chain variable region nucleotide sequence:

(SEQ ID NO: 239)
GAAATTGTGATGACGCAGTCTCCCGACACCCTGTCTGTCTCTCCAGGG

GAGACAGTCACACTCTCCTGCAGGGCCAGTCAGAATATTAACAAGAAT

TTAGCCTGGTACCAATACAAACCTGGCCAGTCTCCCAGGCTCGTAATTT

TTGAAACATATAGCAAGATCGCTGCTTTCCCTGCCAGGTTCGTTGCCAG

TGGTTCTGGGACAGAGTTCACTCTCACCATCAACAACATGCAGTCTGA

AGATGTTGCAGTTTATTACTGTCAACAATATGAAGAGTGGCCTCGGAC

GTTCGGGCAAGGGACCAAGGTGGATATCAAA

5343_B08 (PGT-135) kappa light chain amino acid sequence: expressed protein with variable region in bold.

(SEQ ID NO: 240)
METPAQLLFLLLLWLPDTTGEIVMTQSPDTLSVSPGETVTLSCRASQN

INKNLAWYQYKPGQSPRLVIFETYSKIAAFPARFVASGSGTEFTLTINN

MQSEDVAVYYCQQYEEWPRTFGQGTKVDIKRTVAAPSVFIFPPSDEQL

KSGTASVVCLLNNFYPREAKVQWKVDNALQSGNSQESVTEQDSKDSTYS

LSSTLTLSKADYEKHKVYACEVTHQGLSSPVTKSFNRGEC

5343_B08 (PGT-135) kappa light chain variable region amino acid sequence: (Kabat CDRs underlined, Chothia CDRs in bold italics)

(SEQ ID NO: 242)
EIVMTQSPDTLSVSPGETVTLSC<u>*RASQNINKNLA*</u>WYQYKPGQSPRLVIF

<u>*ETYSKIA*</u>AFPARFVASGSGTEFTLTINNMQSEDVAVYYC<u>*QQYEEWPRT*</u>

FGQGTKVDIK

5343_B08 (PGT-135) kappa light chain Kabat CDRs:

CDR 1: RASQNINKNLA (SEQ ID NO: 243)

CDR 2: ETYSKIA (SEQ ID NO: 244)

CDR 3: QQYEEWPRT (SEQ ID NO: 245)

5343_B08 (PGT-135) kappa light chain Chothia CDRs:

CDR 1: RASQNINKNLA (SEQ ID NO: 243)

CDR 2: ETYSKIA (SEQ ID NO: 244)

CDR 3: QQYEEWPRT (SEQ ID NO: 245)

5344_E16 (PGT-135) gamma heavy chain nucleotide sequence: coding sequence (variable region in bold)

(SEQ ID NO: 229)
ATGAAACACCTGTGGTTCTTCCTCTTGCTGGTGGCGGCTCCCAGATGGG

TCCTGTCCCAGTTGCAGATGCAGGAGTCGGGCCCAGGACTGGTGA

AGCCTTCGGAGACCCTGTCTCTGAGTTGCACTGTCTCTGGTGACT

CCATAAGGGGTGGCGAGTGGGGCGATAAAGATTATCATTGGGGCT

GGGTCCGCCACTCAGCAGGAAAGGGCCTGGAGTGGATTGGGAGT

ATCCATTGGAGGGGGACCACCCACTACAAAGAGTCCCTCAGGAGA

AGAGTGAGTATGTCGATCGACACGTCCAGGAATTGGTTCTCCCTG

AGGCTGGCCTCTGTGACCGCCGCGGACACGGCCGTCTACTTTTGT

GCGAGACACCGACATCATGATGTTTTCATGTTGGTCCCTATTGCG

GGCTGGTTCGACGTCTGGGGCCCGGGAGTCCAGGTCACCGTCTCG

AGCGCCTCCACCAAGGGCCCATCGGTCTTCCCCCTGGCACCCTCCTCC

AAGAGCACCTCTGGGGGCACAGCGGCCCTGGGCTGCCTGGTCAAGGA

CTACTTCCCCGAACCGGTGACGGTGTCGTGGAACTCAGGCGCCCTGAC

CAGCGGCGTGCACACCTTCCCGGCTGTCCTACAGTCCTCAGGACTCTA

CTCCCTCAGCAGCGTGGTGACCGTGCCCTCCAGCAGCTTGGGCACCCA

GACCTACATCTGCAACGTGAATCACAAGCCCAGCAACACCAAGGTGG

ACAAGAGAGTTGAGCCCAAATCTTGTGACAAAACTCACACATGCCCAC

CGTGCCCAGCACCTGAACTCCTGGGGGGACCGTCAGTCTTCCTCTTCCC

CCCAAAACCCAAGGACACCCTCATGATCTCCCGGACCCCTGAGGTCAC

ATGCGTGGTGGTGGACGTGAGCCACGAAGACCCTGAGGTCAAGTTCAA

CTGGTACGTGGACGGCGTGGAGGTGCATAATGCCAAGACAAAGCCGC

GGGAGGAGCAGTACAACAGCACGTACCGTGTGGTCAGCGTCCTCACCG

-continued

TCCTGCACCAGGACTGGCTGAATGGCAAGGAGTACAAGTGCAAGGTCT

CCAACAAAGCCCTCCCAGCCCCCATCGAGAAAACCATCTCCAAAGCCA

AAGGGCAGCCCCGAGAACCACAGGTGTACACCCTGCCCCCATCCCGG

GAGGAGATGACCAAGAACCAGGTCAGCCTGACCTGCCTGGTCAAAGG

CTTCTATCCCAGCGACATCGCCGTGGAGTGGGAGAGCAATGGGCAGCC

GGAGAACAACTACAAGACCACGCCTCCCGTGCTGGACTCCGACGGCTC

CTTCTTCCTCTATAGCAAGCTCACCGTGGACAAGAGCAGGTGGCAGCA

GGGGAACGTCTTCTCATGCTCCGTGATGCATGAGGCTCTGCACAACCA

CTACACGCAGAAGAGCCTCTCCCTGTCTCCGGGTAAATGA

5344_E16 (PGT-135) gamma heavy chain variable region nucleotide sequence:

(SEQ ID NO: 230)
CAGTTGCAGATGCAGGAGTCGGGCCCAGGACTGGTGAAGCCTTCGGA

GACCCTGTCTCTGAGTTGCACTGTCTCTGGTGACTCCATAAGGGGTGGC

GAGTGGGGCGATAAAGATTATCATTGGGGCTGGGTCCGCCACTCAGCA

GGAAAGGGCCTGGAGTGGATTGGGAGTATCCATTGGAGGGGGACCAC

CCACTACAAAGAGTCCCTCAGGAGAAGAGTGAGTATGTCGATCGACAC

GTCCAGGAATTGGTTCTCCCTGAGGCTGGCCTCTGTGACCGCCGCGGA

CACGGCCGTCTACTTTTGTGCGAGACACCGACATCATGATGTTTTCATG

TTGGTCCCTATTGCGGGCTGGTTCGACGTCTGGGGCCCGGGAGTCCAG

GTCACCGTCTCGAGC

5344_E16 (PGT-135) gamma heavy chain amino acid sequence: expressed protein with variable region in bold.

(SEQ ID NO: 231)
MKHLWFFLLLLVAAPRWVLSQLQMQESGPGLVKPSETLSLSCTVSGDS

IRGGEWGDKDYHWGWVRHSAGKGLEWIGSIHWRGTTHYKESLRRR

VSMSIDTSRNWFSLRLASVTAADTAVYFCARHRHHDVFMLVPIAGWF

DVWGPGVQVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDKRVEPKSCDKTHTCPPCPAPELLGGPSVFLFPPKPKDTLMIS

RTPEVTCVVVDVSHEDPEVKFNWYVDGVEVHNAKTKPREEQYNSTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK

5344_E16 (PGT-135) gamma heavy chain variable region amino acid sequence: (Kabat CDRs underlined. Chothia CDRs in bold italics)

(SEQ ID NO: 232)
QLQMQESGPGLVKPSETLSLSCTVS*GDSIRGGEWGDKD*YHWGWVRHS

AGKGLEWIG*SIHWRGTTH*YKESLRRRVSMSIDTSRNWFSLRLASVTA

ADTAVYFCAR*HRHHDVFMLVPIAGWFDV*WGPGVQVTVSS

5344_E16 (PGT-135) gamma heavy chain Kabat CDRs:

(SEQ ID NO: 233)
CDR 1: GGEWGDKDYHWG (SEQ ID NO: 234)
CDR 2: SIHWRGTTHYKESLRR (SEQ ID NO: 235)
CDR 3: HRHHDVFMLVPIAGWFDV

5344_E16 (PGT-135) gamma heavy chain Chothia CDRs:

(SEQ ID NO: 236)
CDR 1: GDSIRGGEWGDKD (SEQ ID NO: 237)
CDR 2: SIHWRGTTH (SEQ ID NO: 235)
CDR 3: HRHHDVFMLVPIAGWFDV

5344_E16 (PGT-135) kappa light chain nucleotide sequence: coding sequence (variable region in bold)

(SEQ ID NO: 238)
ATGGAAACCCCAGCTCAGCTTCTCTTCCTCCTGCTACTCTGGCTCCCAG

ATACCACTGGAGAAATTGTGATGACGCAGTCTCCCGACACCCTGTC

TGTCTCTCCAGGGGAGACAGTCACACTCTCCTGCAGGGCCAGTCA

GAATATTAACAAGAATTTAGCCTGGTACCAATACAAACCTGGCCA

GTCTCCCAGGCTCGTAATTTTTGAAACATATAGCAAGATCGCTGCT

TTCCCTGCCAGGTTCGTTGCCAGTGGTTCTGGGACAGAGTTCACT

CTCACCATCAACAACATGCAGTCTGAAGATGTTGCAGTTTATTACT

GTCAACAATATGAAGAGTGGCCTCGGACGTTCGGGCAAGGGACCA

AGGTGGATATCAAACGTACGGTGGCTGCACCATCTGTCTTCATCTTCC

CGCCATCTGATGAGCAGTTGAAATCTGGAACTGCCTCTGTTGTGTGCCT

GCTGAATAACTTCTATCCCAGAGAGGCCAAAGTACAGTGGAAGGTGG

ATAACGCCCTCCAATCGGGTAACTCCCAGGAGAGTGTCACAGAGCAGG

ACAGCAAGGACAGCACCTACAGCCTCAGCAGCACCCTGACGCTGAGC

AAAGCAGACTACGAGAAACACAAAGTCTACGCCTGCGAAGTCACCCA

TCAGGGCCTGAGCTCGCCCGTCACAAAGAGCTTCAACAGGGGAGAGT

GTTAG

5344_E16 (PGT-135) kappa light chain variable region nucleotide sequence:

(SEQ ID NO: 239)
GAAATTGTGATGACGCAGTCTCCCGACACCCTGTCTGTCTCTCCAGGG

GAGACAGTCACACTCTCCTGCAGGGCCAGTCAGAATATTAACAAGAAT

TTAGCCTGGTACCAATACAAACCTGGCCAGTCTCCCAGGCTCGTAATTT

TTGAAACATATAGCAAGATCGCTGCTTTCCCTGCCAGGTTCGTTGCCAG

TGGTTCTGGGACAGAGTTCACTCTCACCATCAACAACATGCAGTCTGA

AGATGTTGCAGTTTATTACTGTCAACAATATGAAGAGTGGCCTCGGAC

GTTCGGGCAAGGGACCAAGGTGGATATCAAA

5344_E16 (PGT-135) kappa light chain amino acid sequence: expressed protein with variable region in bold.

(SEQ ID NO: 240)
METPAQLLFLLLLWLPDTTGEIVMTQSPDTLSVSPGETVTLSCRASQN

INKNLAWYQYKPGQSPRLVIFETYSKIAAFPARFVASGSGTEFTLTINN

MQSEDVAVYYCQQYEEWPRTFGQGTKVDIKRTVAAPSVFIFPPSDEQL

KSGTASVVCLLNNFYPREAKVQWKVDNALQSGNSQESVTEQDSKDSTYS

LSSTLTLSKADYEKHKVYACEVTHQGLSSPVTKSFNRGEC

5344_E16 (PGT-135) kappa light chain variable region amino acid sequence: (Kabat CDRs underlined, Chothia CDRs in bold italics)

(SEQ ID NO: 242)
EIVMTQSPDTLSVSPGETVTLSC*RASQNINKNLA*WYQYKPGQSPRLVIF

*ETYSKIA*AFPARFVASGSGTEFTLTINNMQSEDVAVYYC*QQYEEWPRT*F

GQGTKVDIK

5344_E16 (PGT-135) kappa light chain Kabat CDRs:

(SEQ ID NO: 243)
CDR 1: RASQNINKNLA (SEQ ID NO: 244)
CDR 2: ETYSKIA (SEQ ID NO: 245)
CDR 3: QQYEEWPRT

5344_E16 (PGT-135) kappa light chain Chothia CDRs:

(SEQ ID NO: 243)
CDR 1: RASQNINKNLA (SEQ ID NO: 244)
CDR 2: ETYSKIA (SEQ ID NO: 245)
CDR 3: QQYEEWPRT

5329_C19 (PGT-136) gamma heavy chain nucleotide sequence: coding sequence (variable region in bold)

(SEQ ID NO: 246)
ATGAAACACCTGTGGTTCTTCCTCCTGCTAGTGGCGGCTCCCAGATGG

GTCCTGTCGCAGCTGCAGTTGCAGGAATCGGGCCCAGGACTGGTG

AAGCCTTCGGAGACCCTGTCCCTGACTTGCACAGTTTCTGGTGGC

TCCATGAGGGGCACCGACTGGGGCGAGAATGACTTCCACTACGGC

TGGATCCGCCAGTCCTCCGCAAAGGGGCTGGAGTGGATTGGGAGC

ATCCATTGGAGGGGAGGACCACCCACTACAAGACGTCCTTCAGG

AGTCGGGCCACCTTGTCGATAGACACGTCCAATAATCGCTTCTCC

CTGACGTTTAGTTTTGTGACCGCCGCGGACACGGCCGTCTACTAT

TGTGCGAGACATAAATATCATGATATTTTCAGGGTGGTCCCTGTTG

CGGGCTGGTTCGACCCCTGGGGCCAGGGATTACTGGTCACCGTCT

CGAGCGCCTCCACCAAGGGCCCATCGGTCTTCCCCCTGGCACCCTCCT

CCAAGAGCACCTCTGGGGGCACAGCGGCCCTGGGCTGCCTGGTCAAG

GACTACTTCCCCGAACCGGTGACGGTGTCGTGGAACTCAGGCGCCCTG

ACCAGCGGCGTGCACACCTTCCCGGCTGTCCTACAGTCCTCAGGACTC

TACTCCCTCAGCAGCGTGGTGACCGTGCCCTCCAGCAGCTTGGGCACC

CAGACCTACATCTGCAACGTGAATCACAAGCCCAGCAACACCAAGGT

GGACAAGAGAGTTGAGCCCAAATCTTGTGACAAAACTCACACATGCCC

ACCGTGCCCAGCACCTGAACTCCTGGGGGGACCGTCAGTCTTCCTCTT

CCCCCCAAAACCCAAGGACACCCTCATGATCTCCCGGACCCCTGAGGT

CACATGCGTGGTGGTGGACGTGAGCCACGAAGACCCTGAGGTCAAGTT

CAACTGGTACGTGGACGGCGTGGAGGTGCATAATGCCAAGACAAAGC

CGCGGGAGGAGCAGTACAACAGCACGTACCGTGTGGTCAGCGTCCTCA

CCGTCCTGCACCAGGACTGGCTGAATGGCAAGGAGTACAAGTGCAAG

GTCTCCAACAAAGCCCTCCCAGCCCCCATCGAGAAAACCATCTCCAAA

GCCAAAGGGCAGCCCCGAGAACCACAGGTGTACACCCTGCCCCCATCC

CGGGAGGAGATGACCAAGAACCAGGTCAGCCTGACCTGCCTGGTCAA

AGGCTTCTATCCCAGCGACATCGCCGTGGAGTGGGAGAGCAATGGGCA

GCCGGAGAACAACTACAAGACCACGCCTCCCGTGCTGGACTCCGACG

GCTCCTTCTTCCTCTATAGCAAGCTCACCGTGGACAAGAGCAGGTGGC

AGCAGGGGAACGTCTTCTCATGCTCCGTGATGCATGAGGCTCTGCACA

ACCACTACACGCAGAAGAGCCTCTCCCTGTCTCCGGGTAAATGA

5329_C19 (PGT-136) gamma heavy chain variable region nucleotide sequence:

(SEQ ID NO: 247)
CAGCTGCAGTTGCAGGAATCGGGCCCAGGACTGGTGAAGCCTTCGGAG

ACCCTGTCCCTGACTTGCACAGTTTCTGGTGGCTCCATGAGGGGCACC

GACTGGGGCGAGAATGACTTCCACTACGGCTGGATCCGCCAGTCCTCC

GCAAAGGGGCTGGAGTGGATTGGGAGCATCCATTGGAGGGGAGGAC

CACCCACTACAAGACGTCCTTCAGGAGTCGGGCCACCTTGTCGATAGA

CACGTCCAATAATCGCTTCTCCCTGACGTTTAGTTTTGTGACCGCCGCG

GACACGGCCGTCTACTATTGTGCGAGACATAAATATCATGATATTTTC

AGGGTGGTCCCTGTTGCGGGCTGGTTCGACCCCTGGGGCCAGGGATTA

CTGGTCACCGTCTCGAGC

5329_C19 (PGT-136) gamma heavy chain amino acid sequence: expressed protein with variable region in bold.

(SEQ ID NO: 248)
MKHLWFFLLLVAAPRWVLSQLQLQESGPGLVKPSETLSLTCTVSGGS

MRGTDWGENDFHYGWIRQSSAKGLEWIGSIHWRGRTTHYKTSFRSR

ATLSIDTSNNRFSLTFSFVTAADTAVYYCARHKYHDIFRVVPVAGWFD

PWGQGLLVTVSSASTKGPSVFPLAPSSKSTSGGTAALGCLVKDYFPEPVT

VSWNSGALTSGVHTFPAVLQSSGLYSLSSVVTVPSSSLGTQTYICNVNHK

PSNTKVDKRVEPKSCDKTHTCPPCPAPELLGGPSVFLFPPKPKDTLMISR

```
TPEVTCVVVDVSHEDPEVKFNWYVDGVEVHNAKTKPREEQYNSTYRVVSV

LTVLHQDWLNGKEYKCKVSNKALPAPIEKTISKAKGQPREPQVYTLPPSR

EEMTKNQVSLTCLVKGFYPSDIAVEWESNGQPENNYKTTPPVLDSDGSFF

LYSKLTVDKSRWQQGNVFSCSVMHEALHNHYTQKSLSLSPGK
```

5329_C19 (PGT-136) gamma heavy chain variable region amino acid sequence:
(Kabat CDRs underlined, Chothia CDRs in bold italics)

```
                                        (SEQ ID NO: 249)
QLQLQESGPGLVKPSETLSLTCTVSGGSMRGTDWGENDFHYGWIRQS

SAKGLEWIG***SIHWRGRTTH***YKTSFRSRATLSIDTSNNRFSLTFSFVT

AADTAVYYCARHKYHDIFRVVPVAGWFDPWGQGLLVTVSS
```

5329_C19 (PGT-136) gamma heavy chain Kabat CDRs:

```
                                        (SEQ ID NO: 250)
        CDR 1: GTDWGENDFHYG (SEQ ID NO: 251)
        CDR 2: SIHWRGRTTHYKTSFRS (SEQ ID NO: 252)
        CDR 3: HKYHDIFRVVPVAGWFDP
```

5329_C19 (PGT-136) gamma heavy chain Chothia CDRs:

```
                                        (SEQ ID NO: 253)
        CDR 1: GGSMRGTDWGEND (SEQ ID NO: 254)
        CDR 2: SIHWRGRTTH (SEQ ID NO: 252)
        CDR 3: HKYHDIFRVVPVAGWFDP
```

5329_C19 (PGT-136) kappa light chain nucleotide sequence: coding sequence (variable region in bold)

```
                                        (SEQ ID NO: 255)
ATGGAAACCCCAGCTCAGCTTCTCTTCCTCCTGCTACTCTGGCTCCCAG

ATAGCACTGGAGAAATAGTGATGACGCAGTCTCCACCCACCCTGTC

TGTGTCTCCAGGGGAAACAGCCACACTCTCCTGTAGGGCCAGTCA

GAATGTTAAGAATAATTTAGCCTGGTACCAGCTGAAACCTGGCCA

GGCTCCCAGGCTCCTCATCTTTGATGCGTCCAGCAGGGCCGGTGG

TATTCCTGACAGGTTCAGTGGCAGCGGTTATGGGACAGACTTCAC

TCTCACCGTCAACAGTGTGCAGTCCGAAGATTTTGGAGATTATTTT

TGTCAGCAATATGAAGAGTGGCCTCGGACGTTCGGCCAAGGGACC

AAGGTGGATATCAAACGTACGGTGGCTGCACCATCTGTCTTCATCTTC

CCGCCATCTGATGAGCAGTTGAAATCTGGAACTGCCTCTGTTGTGTGCC

TGCTGAATAACTTCTATCCCAGAGAGGCCAAAGTACAGTGGAAGGTGG

ATAACGCCCTCCAATCGGGTAACTCCCAGGAGAGTGTCACAGAGCAGG

ACAGCAAGGACAGCACCTACAGCCTCAGCAGCACCCTGACGCTGAGC

AAAGCAGACTACGAGAAACACAAAGTCTACGCCTGCGAAGTCACCCA
```

```
TCAGGGCCTGAGCTCGCCCGTCACAAAGAGCTTCAACAGGGGAGAGT

GTTAG
```

5329_C19 (PGT-136) kappa light chain variable region nucleotide sequence:

```
                                        (SEQ ID NO: 256)
GAAATAGTGATGACGCAGTCTCCACCCACCCTGTCTGTGTCTCCAGGG

GAAACAGCCACACTCTCCTGTAGGGCCAGTCAGAATGTTAAGAATAAT

TTAGCCTGGTACCAGCTGAAACCTGGCCAGGCTCCCAGGCTCCTCATC

TTTGATGCGTCCAGCAGGGCCGGTGGTATTCCTGACAGGTTCAGTGGC

AGCGGTTATGGGACAGACTTCACTCTCACCGTCAACAGTGTGCAGTCC

GAAGATTTTGGAGATTATTTTTGTCAGCAATATGAAGAGTGGCCTCGG

ACGTTCGGCCAAGGGACCAAGGTGGATATCAAA
```

5329_C19 (PGT-136) kappa light chain amino acid sequence: expressed protein with variable region in bold.

```
                                        (SEQ ID NO: 257)
METPAQLLFLLLLWLPDSTGEIVMTQSPPTLSVSPGETATLSCRASQN

VKNNLAWYQLKPGQAPRLLIFDASSRAGGIPDRFSGSGYGTDFTLTVN

SVQSEDFGDYFCQQYEEWPRTFGQGTKVDIKRTVAAPSVFIFPPSDEQL

KSGTASVVCLLNNFYPREAKVQWKVDNALQSGNSQESVTEQDSKDSTYS

LSSTLTLSKADYEKHKVYACEVTHQGLSSPVTKSFNRGEC
```

5329_C19 (PGT-136) kappa light chain variable region amino acid sequence: (Kabat CDRs underlined, Chothia CDRs in bold italics)

```
                                        (SEQ ID NO: 258)
EIVMTQSPPTLSVSPGETATLSC*RASQNVKNNLA*WYQLKPGQAPRLLIF

*DASSRAG*GIPDRFSGSGYGTDFTLTVNSVQSEDFGDYFC

*QQYEEWPRT*FGQGTKVDIK
```

5329 C19 (PGT-136) kappa light chain Kabat CDRs:

```
                                        (SEQ ID NO: 259)
        CDR 1: RASQNVKNNLA (SEQ ID NO: 260)
        CDR 2: DASSRAG (SEQ ID NO: 245)
        CDR 3: QQYEEWPRT
```

5329 C19 (PGT-136) kappa light chain Chothia CDRs:

```
                                        (SEQ ID NO: 259)
        CDR 1: RASQNVKNNLA (SEQ ID NO: 260)
        CDR 2: DASSRAG (SEQ ID NO: 245)
        CDR 3: QQYEEWPRT
```

5366_P21 (PGT-136) gamma heavy chain nucleotide sequence: coding sequence (variable region in bold)

(SEQ ID NO: 246)
ATGAAACACCTGTGGTTCTTCCTCCTGCTAGTGGCGGCTCCCAGATGG

GTCCTGTCGCAGCTGCAGTTGCAGGAATCGGGCCCAGGACTGGTG

AAGCCTTCGGAGACCCTGTCCCTGACTTGCACAGTTTCTGGTGGC

TCCATGAGGGGCACCGACTGGGGCGAGAATGACTTCCACTACGGC

TGGATCCGCCAGTCCTCCGCAAAGGGGCTGGAGTGGATTGGGAGC

ATCCATTGGAGGGGAGGACCACCCACTACAAGACGTCCTTCAGG

AGTCGGGCCACCTTGTCGATAGACACGTCCAATAATCGCTTCTCC

CTGACGTTTAGTTTTGTGACCGCCGCGGACACGGCCGTCTACTAT

TGTGCGAGACATAAATATCATGATATTTTCAGGGTGGTCCCTGTTG

CGGGCTGGTTCGACCCCTGGGGCCAGGGATTACTGGTCACCGTCT

CGAGCGCCTCCACCAAGGGCCCATCGGTCTTCCCCCTGGCACCCTCCT

CCAAGAGCACCTCTGGGGGCACAGCGGCCCTGGGCTGCCTGGTCAAG

GACTACTTCCCCGAACCGGTGACGGTGTCGTGGAACTCAGGCGCCCTG

ACCAGCGGCGTGCACACCTTCCCGGCTGTCCTACAGTCCTCAGGACTC

TACTCCCTCAGCAGCGTGGTGACCGTGCCCTCCAGCAGCTTGGGCACC

CAGACCTACATCTGCAACGTGAATCACAAGCCCAGCAACACCAAGGT

GGACAAGAGAGTTGAGCCCAAATCTTGTGACAAAACTCACACATGCCC

ACCGTGCCCAGCACCTGAACTCCTGGGGGGACCGTCAGTCTTCCTCTT

CCCCCCAAAACCCAAGGACACCCTCATGATCTCCCGGACCCCTGAGGT

CACATGCGTGGTGGTGGACGTGAGCCACGAAGACCCTGAGGTCAAGTT

CAACTGGTACGTGGACGGCGTGGAGGTGCATAATGCCAAGACAAAGC

CGCGGGAGGAGCAGTACAACAGCACGTACCGTGTGGTCAGCGTCCTCA

CCGTCCTGCACCAGGACTGGCTGAATGGCAAGGAGTACAAGTGCAAG

GTCTCCAACAAAGCCCTCCCAGCCCCCATCGAGAAAACCATCTCCAAA

GCCAAAGGGCAGCCCCGAGAACCACAGGTGTACACCCTGCCCCCATCC

CGGGAGGAGATGACCAAGAACCAGGTCAGCCTGACCTGCCTGGTCAA

AGGCTTCTATCCCAGCGACATCGCCGTGGAGTGGGAGAGCAATGGGCA

GCCGGAGAACAACTACAAGACCACGCCTCCCGTGCTGGACTCCGACG

GCTCCTTCTTCCTCTATAGCAAGCTCACCGTGGACAAGAGCAGGTGGC

AGCAGGGGAACGTCTTCTCATGCTCCGTGATGCATGAGGCTCTGCACA

ACCACTACACGCAGAAGAGCCTCTCCCTGTCTCCGGGTAAATGA

5366_P21 (PGT-136) gamma heavy chain variable region nucleotide sequence:

(SEQ ID NO: 247)
CAGCTGCAGTTGCAGGAATCGGGCCCAGGACTGGTGAAGCCTTCGGAG

ACCCTGTCCCTGACTTGCACAGTTTCTGGTGGCTCCATGAGGGGCACC

GACTGGGGCGAGAATGACTTCCACTACGGCTGGATCCGCCAGTCCTCC

GCAAAGGGGCTGGAGTGGATTGGGAGCATCCATTGGAGGGGAGGAC

CACCCACTACAAGACGTCCTTCAGGAGTCGGGCCACCTTGTCGATAGA

CACGTCCAATAATCGCTTCTCCCTGACGTTTAGTTTTGTGACCGCCGCG

GACACGGCCGTCTACTATTGTGCGAGACATAAATATCATGATATTTTC

AGGGTGGTCCCTGTTGCGGGCTGGTTCGACCCCTGGGGCCAGGGATTA

CTGGTCACCGTCTCGAGC

5366_P21 (PGT-136) gamma heavy chain amino acid sequence: expressed protein with variable region in bold.

(SEQ ID NO: 248)
MKHLWFFLLLVAAPRWVLSQLQLQESGPGLVKPSETLSLTCTVSGGS

MRGTDWGENDFHYGWIRQSSAKGLEWIGSIHWRGRTTHYKTSFRSR

ATLSIDTSNNRFSLTFSFVTAADTAVYYCARHKYHDIFRVVPVAGWFD

PWGQGLLVTVSSASTKGPSVFPLAPSSKSTSGGTAALGCLVKDYFPEPVT

VSWNSGALTSGVHTFPAVLQSSGLYSLSSVVTVPSSSLGTQTYICNVNHK

PSNTKVDKRVEPKSCDKTHTCPPCPAPELLGGPSVFLFPPKPKDTLMISR

TPEVTCVVVDVSHEDPEVKFNWYVDGVEVHNAKTKPREEQYNSTYRVVSV

LTVLHQDWLNGKEYKCKVSNKALPAPIEKTISKAKGQPREPQVYTLPPSR

EEMTKNQVSLTCLVKGFYPSDIAVEWESNGQPENNYKTTPPVLDSDGSFF

LYSKLTVDKSRWQQGNVFSCSVMHEALHNHYTQKSLSLSPGK

5366_P21 (PGT-136) gamma heavy chain variable region amino acid sequence: (Kabat CDRs underlined, Chothia CDRs in bold italics)

(SEQ ID NO: 249)
QLQLQESGPGLVKPSETLSLTCTVS*GGSMR**GTDWGEND*FHYGWIRQS

SAKGLEWIG*SIHWRGRTTH*YKTSFRSRATLSIDTSNNRFSLTFSFVT

AADTAVYYCAR*HKYHDIFRVVPVAGWFDP*WGQGLLVTVSS

5366_P21 (PGT-136) gamma heavy chain Kabat CDRs:

(SEQ ID NO: 250)
CDR 1: GTDWGENDFHYG (SEQ ID NO: 251)
CDR 2: SIHWRGRTTHYKTSFRS (SEQ ID NO: 252)
CDR 3: HKYHDIFRVVPVAGWFDP

5366_P21 (PGT-136) gamma heavy chain Chothia CDRs:

(SEQ ID NO: 253)
CDR 1: GGSMRGTDWGEND (SEQ ID NO: 254)
CDR 2: SIHWRGRTTH (SEQ ID NO: 252)
CDR 3: HKYHDIFRVVPVAGWFDP

5366_P21 (PGT-136) kappa light chain nucleotide sequence: coding sequence (variable region in bold)

(SEQ ID NO: 255)
ATGGAAACCCCAGCTCAGCTTCTCTTCCTCCTGCTACTCTGGCTCCCAG

ATAGCACTGGAGAAATAGTGATGACGCAGTCTCCACCCACCCTGTC

TGTGTCTCCAGGGGAAACAGCCACACTCTCCTGTAGGGCCAGTCA

GAATGTTAAGAATAATTTAGCCTGGTACCAGCTGAAACCTGGCCA

GGCTCCCAGGCTCCTCATCTTTGATGCGTCCAGCAGGGCCGGTGG

TATTCCTGACAGGTTCAGTGGCAGCGGTTATGGGACAGACTTCAC

TCTCACCGTCAACAGTGTGCAGTCCGAAGATTTTGGAGATTATTTT

TGTCAGCAATATGAAGAGTGGCCTCGGACGTTCGGCCAAGGGACC

AAGGTGGATATCAAACGTACGGTGGCTGCACCATCTGTCTTCATCTTC

CCGCCATCTGATGAGCAGTTGAAATCTGGAACTGCCTCTGTTGTGTGCC

TGCTGAATAACTTCTATCCCAGAGAGGCCAAAGTACAGTGGAAGGTGG

ATAACGCCCTCCAATCGGGTAACTCCCAGGAGAGTGTCACAGAGCAGG

ACAGCAAGGACAGCACCTACAGCCTCAGCAGCACCCTGACGCTGAGC

AAAGCAGACTACGAGAAACACAAAGTCTACGCCTGCGAAGTCACCCA

TCAGGGCCTGAGCTCGCCCGTCACAAAGAGCTTCAACAGGGGAGAGT

GTTAG

5366_P21 (PGT-136) kappa light chain variable region nucleotide sequence:

(SEQ ID NO: 256)
GAAATAGTGATGACGCAGTCTCCACCCACCCTGTCTGTGTCTCCAGGG

GAAACAGCCACACTCTCCTGTAGGGCCAGTCAGAATGTTAAGAATAAT

TTAGCCTGGTACCAGCTGAAACCTGGCCAGGCTCCCAGGCTCCTCATC

TTTGATGCGTCCAGCAGGGCCGGTGGTATTCCTGACAGGTTCAGTGGC

AGCGGTTATGGGACAGACTTCACTCTCACCGTCAACAGTGTGCAGTCC

GAAGATTTTGGAGATTATTTTTGTCAGCAATATGAAGAGTGGCCTCGG

ACGTTCGGCCAAGGGACCAAGGTGGATATCAAA

5366_P21 (PGT-136) kappa light chain amino acid sequence: expressed protein with variable region in bold.

(SEQ ID NO: 257)
METPAQLLFLLLLWLPDSTGEIVMTQSPPTLSVSPGETATLSCRASQN

VKNNLAWYQLKPGQAPRLLIFDASSRAGGIPDRFSGSGYGTDFTLTVN

SVQSEDFGDYFCQQYEEWPRTFGQGTKVDIKRTVAAPSVFIFPPSDEQL

KSGTASVVCLLNNFYPREAKVQWKVDNALQSGNSQESVTEQDSKDSTYS

LSSTLTLSKADYEKHKVYACEVTHQGLSSPVTKSFNRGEC

5366_P21 (PGT-136) kappa light chain variable region amino acid sequence: (Kabat CDRs underlined, Chothia CDRs in bold italics)

(SEQ ID NO: 258)
EIVMTQSPPTLSVSPGETATLSC*RASQNVKNNLA*WYQLKPGQAPRLLIF

*DASSRAG*GIPDRFSGSGYGTDFTLTVNSVQSEDFGDYFC

*QQYEEWPRT*FGQGTKVDIK

5366_P21 (PGT-136) kappa light chain Kabat CDRs:

(SEQ ID NO: 259)
CDR 1: RASQNVKNNLA (SEQ ID NO: 260)
CDR 2: DASSRAG (SEQ ID NO: 245)
CDR 3: QQYEEWPRT

5366_P21 (PGT-136) kappa light chain Chothia CDRs:

(SEQ ID NO: 259)
CDR 1: RASQNVKNNLA (SEQ ID NO: 260)
CDR 2: DASSRAG (SEQ ID NO: 245)
CDR 3: QQYEEWPRT

4964_G22 (PGT-141) gamma heavy chain nucleotide sequence: coding sequence (variable region in bold)

(SEQ ID NO: 273)
ATGGACTGGATTTGGAGGATCCTCTTCTTGGTGGCAGCAGTTGCAAGT

GCCCACTCGCAGGTGCAGCTGGTGCAGTCTGGGCCGAGGTGAAG

AAGCCTGGGTCCTCAGTGAAGGTCTCCTGCAAGGCCTCTGGAAAC

ACCTTCAGTAAATATGATGTCCACTGGGTACGACAGGCCACTGGA

CAGGGGCTTGAATGGGTGGGATGGATGAGTCATGAGGGTGATAA

GACAGAATCTGCACAGAGATTTAAGGGCCGAGTCACCTTCACGAG

GGACACTTCCGCAAGCACAGCCTACATGGAACTGCGCGGCCTGAC

ATCTGACGACACGGCCATCTATTATTGTACGAGAGGCTCAAAACA

TCGTTTGCGAGACTACGTTCTCTACGATGACTACGGCTTAATTAAT

TATCAAGAGTGGAATGACTACCTTGAATTTTTGGACGTCTGGGGC

CATGGAACCGCGGTCACCGTCTCCTCAGCCTCCACCAAGGGCCCAT

CGGTCTTCCCCCTGGCACCCTCCTCCAAGAGCACCTCTGGGGGCACAG

CGGCCCTGGGCTGCCTGGTCAAGGACTACTTCCCCGAACCGGTGACGG

TGTCGTGGAACTCAGGCGCCCTGACCAGCGGCGTGCACACCTTCCCGG

CTGTCCTACAGTCCTCAGGACTCTACTCCCTCAGCAGCGTGGTGACCGT

GCCCTCCAGCAGCTTGGGCACCCAGACCTACATCTGCAACGTGAATCA

CAAGCCCAGCAACACCAAGGTGGACAAGAGAGTTGAGCCCAAATCTT

GTGACAAAACTCACACATGCCCACCGTGCCCAGCACCTGAACTCCTGG

GGGGACCGTCAGTCTTCCTCTTCCCCCCAAAACCCAAGGACACCCTCA

TGATCTCCCGGACCCCTGAGGTCACATGCGTGGTGGTGGACGTGAGCC

ACGAAGACCCTGAGGTCAAGTTCAACTGGTACGTGGACGGCGTGGAG

GTGCATAATGCCAAGACAAAGCCGCGGGAGGAGCAGTACAACAGCAC

GTACCGTGTGGTCAGCGTCCTCACCGTCCTGCACCAGGACTGGCTGAA

TGGCAAGGAGTACAAGTGCAAGGTCTCCAACAAAGCCCTCCCAGCCCC

CATCGAGAAACCATCTCCAAAGCCAAAGGGCAGCCCCGAGAACCAC

AGGTGTACACCCTGCCCCCATCCCGGGAGGAGATGACCAAGAACCAG

GTCAGCCTGACCTGCCTGGTCAAAGGCTTCTATCCCAGCGACATCGCC

GTGGAGTGGGAGAGCAATGGGCAGCCGGAGAACAACTACAAGACCAC

```
GCCTCCCGTGCTGGACTCCGACGGCTCCTTCTTCCTCTATAGCAAGCTC

ACCGTGGACAAGAGCAGGTGGCAGCAGGGGAACGTCTTCTCATGCTCC

GTGATGCATGAGGCTCTGCACAACCACTACACGCAGAAGAGCCTCTCC

CTGTCTCCGGGTAAATGA
```

4964_G22 (PGT-141) gamma heavy chain variable region nucleotide sequence:

```
                                (SEQ ID NO: 274)
CAGGTGCAGCTGGTGCAGTCTGGGCCGGAGGTGAAGAAGCCTGG

GTCCTCAGTGAAGGTCTCCTGCAAGGCCTCTGGAAACACCTTCAG

TAAATATGATGTCCACTGGGTACGACAGGCCACTGGACAGGGGCT

TGAATGGGTGGGATGGATGAGTCATGAGGGTGATAAGACAGAATC

TGCACAGAGATTTAAGGGCCGAGTCACCTTCACGAGGGACACTTC

CGCAAGCACAGCCTACATGGAACTGCGCGGCCTGACATCTGACGA

CACGGCCATCTATTATTGTACGAGAGGCTCAAAACATCGTTTGCG

AGACTACGTTCTCTACGATGACTACGGCTTAATTAATTATCAAGAG

TGGAATGACTACCTTGAATTTTTGGACGTCTGGGGCCATGGAACC

GCGGTCACCGTCTCCTCA
```

4964_G22 (PGT-141) gamma heavy chain amino acid sequence: expressed protein with leader sequence in italics and variable region in bold.

```
                                (SEQ ID NO: 275)
MDWIWRILFLVAAVASAHSQVQLVQSGPEVKKPGSSVKVSCKASGNTFSK

YDVHWVRQATGQGLEWVGWMSHEGDKTESAQRFKGRVTFTRDTSA

STAYMELRGLTSDDTAIYYCTRGSKHRLRDYVLYDDYGLINYQEWND

YLEFLDVWGHGTAVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK
```

4964_G22 (PGT-141) gamma heavy chain variable region amino acid sequence:
(Kabat CDRs underlined, Chothia CDRs in bold italics)

```
                                (SEQ ID NO: 276)
QVQLVQSGPEVKKPGSSVKVSCKAS***GNTFSK***YDVHWVRQATGQGLEW

VG***WMSHEGDKTE***RVTFTRDTSASTAYMELRGLTSDDTAIY

YCTR***GSKHRLRDYVLYDDYGLINYQEWNDYLEFLDV***WGHGTAVTVSS
```

4964 G22 (PGT-141) gamma heavy chain Kabat CDRs:

```
                                (SEQ ID NO: 277)
    CDR 1: KYDVH (SEQ ID NO: 278)
    CDR 2: WMSHEGDKTESAQRFKG (SEQ ID NO: 279)
    CDR 3: GSKHRLRDYVLYDDYGLINYQEWNDYLEFLDV
```

4964_G22 (PGT-141) gamma heavy chain Chothia CDRs:

```
                                (SEQ ID NO: 280)
    CDR 1: GNTFSK (SEQ ID NO: 281)
    CDR 2: WMSHEGDKTE (SEQ ID NO: 279)
    CDR 3: GSKHRLRDYVLYDDYGLINYQEWNDYLEFLDV
```

4964_G22 (PGT-141) kappa light chain nucleotide sequence: coding sequence (variable region in bold)

```
                                (SEQ ID NO: 282)
ATGAGGCTCCCTGCTCAGCTCCTGGGGCTGCTAATGCTCTGGGTCTCTG

GATCCAGTGCGGATACTGTCGTGACTCAGTCTCCACTCTCCCTGCC

CGTCACCCCTGGAGAGGCGGCCTCCATGTCCTGTTCGTCGACTCA

GAGCCTCCGGCATAGTAATGGAGCCAACTATTTGGCTTGGTATCA

GCACAAACCGGGGCAGTCTCCACGACTCCTAATCCGTTTAGGTTC

TCAACGGGCCTCCGGGGTCCCTGACAGATTCAGTGGCAGTGGATC

AGGCACTCATTTTACACTGAAAATCAGTAGAGTGGAGGCTGAAGA

TGCTGCAATTTATTATTGCATGCAAGGTCTGAACCGTCCCTGGACG

TTCGGCAAGGGGACCAAGTTGGAAATCAAACGTACGGTGGCTGCAC

CATCTGTCTTCATCTTCCCGCCATCTGATGAGCAGTTGAAATCTGGAAC

TGCCTCTGTTGTGTGCCTGCTGAATAACTTCTATCCCAGAGAGGCCAAA

GTACAGTGGAAGGTGGATAACGCCCTCCAATCGGGTAACTCCCAGGAG

AGTGTCACAGAGCAGGACAGCAAGGACAGCACCTACAGCCTCAGCAG

CACCCTGACGCTGAGCAAAGCAGACTACGAGAAACACAAAGTCTACG

CCTGCGAAGTCACCCATCAGGGCCTGAGCTCGCCCGTCACAAAGAGCT

TCAACAGGGGAGAGTGTTAG
```

4964_G22 (PGT-141) kappa light chain variable region nucleotide sequence:

```
                                (SEQ ID NO: 283)
GATACTGTCGTGACTCAGTCTCCACTCTCCCTGCCCGTCACCCCTG

GAGAGGCGGCCTCCATGTCCTGTTCGTCGACTCAGAGCCTCCGGC

ATAGTAATGGAGCCAACTATTTGGCTTGGTATCAGCACAAACCGG

GGCAGTCTCCACGACTCCTAATCCGTTTAGGTTCTCAACGGGCCT

CCGGGGTCCCTGACAGATTCAGTGGCAGTGGATCAGGCACTCATT

TTACACTGAAAATCAGTAGAGTGGAGGCTGAAGATGCTGCAATTT

ATTATTGCATGCAAGGTCTGAACCGTCCCTGGACGTTCGGCAAGG

GGACCAAGTTGGAAATCAAA
```

4964_G22 (PGT-141) kappa light chain amino acid sequence: expressed protein with leader sequence in italics and variable region in bold.

(SEQ ID NO: 284)
*MRLPAQLLGLLMLWVSGSSA*DTVVTQSPLSLPVTPGEAASMSCSSTQSLR
HSNGANYLAWYQHKPGQSPRLLIRLGSQRASGVPDRFSGSGSGTHFT
LKISRVEAEDAAIYYCMQGLNRPWTFGKGTKLEIKRTVAAPSVFIFPPS
DEQLKSGTASVVCLLNNFYPREAKVQWKVDNALQSGNSQESVTEQDSKD
STYSLSSTLTLSKADYEKHKVYACEVTHQGLSSPVTKSFNRGEC

4964_G22 (PGT-141) kappa light chain variable region amino acid sequence: (Kabat CDRs underlined, Chothia CDRs in bold italics)

(SEQ ID NO: 285)
DTVVTQSPLSLPVTPGEAASMSC*SSTQSLRHSNGANYLA*WYQHKPGQ
SPRLLIR*LGSQRAS*GVPDRFSGSGSGTHFTLKISRVEAEDAAIYYC
*MQGLNRPWT*FGKGTKLEIK

4964_G22 (PGT-141) kappa light chain Kabat CDRs:

```
                                   (SEQ ID NO: 286)
CDR 1: SSTQSLRHSNGANYLA (SEQ ID NO: 287)
CDR 2: LGSQRAS (SEQ ID NO: 288)
CDR 3: MQGLNRPWT
```

4964_G22 (PGT-141) kappa light chain Chothia CDRs:

```
                                   (SEQ ID NO: 286)
CDR 1: SSTQSLRHSNGANYLA (SEQ ID NO: 287)
CDR 2: LGSQRAS (SEQ ID NO: 288)
CDR 3: MQGLNRPWT
```

4993_K13 (PGT-141) gamma heavy chain nucleotide sequence: coding sequence (variable region in bold)

(SEQ ID NO: 289)
ATGGACTGGATTTGGAGGATCCTCTTCTTGGTGGCAGCAGTTGCAAGT
GCCCACTCG**CAGGTGCAGCTGGTGCAGTCTGGGCCTGAGGTGAAG
AAGCCTGGGTCCTCAGTGAAGGTCTCCTGCAAGGCCTCTGGAAAC
ACCTTCAGTAAATATGATGTCCACTGGGTACGGCAGGCCACTGGA
CAGGGGCTTGAATGGGTGGGATGGATGAGTCATGAGGGTGATAA
GACAGAATCTGCACAGAGATTTAAGGGCCGAGTCACCTTCACGAG
GGACACTTCCGCAAGCACAGCCTACATGGAACTGCGCGGCCTGAC
ATCTGACGACACGGCCATTTATTATTGTACGAGAGGCTCAAAACAT
CGCTTGCGAGACTATGTTCTCTACGATGACTACGGCTTAATTAATT
ATCAAGAGTGGAATGACTACCTTGAATTTTTGGACGTCTGGGGCC
ATGGAACCGCGGTCACCGTCTCCTCA**GCCTCCACCAAGGGCCCATC
GGTCTTCCCCCTGGCACCCTCCTCCAAGAGCACCTCTGGGGGCACAGC
GGCCCTGGGCTGCCTGGTCAAGGACTACTTCCCCGAACCGGTGACGGT
GTCGTGGAACTCAGGCGCCCTGACCAGCGGCGTGCACACCTTCCCGGC
TGTCCTACAGTCCTCAGGACTCTACTCCCTCAGCAGCGTGGTGACCGTG
CCCTCCAGCAGCTTGGGCACCCAGACCTACATCTGCAACGTGAATCAC
AAGCCCAGCAACACCAAGGTGGACAAGAGAGTTGAGCCCAAATCTTG
TGACAAAACTCACACATGCCCACCGTGCCCAGCACCTGAACTCCTGGG
GGGACCGTCAGTCTTCCTCTTCCCCCCAAAACCCAAGGACACCCTCAT
GATCTCCCGGACCCCTGAGGTCACATGCGTGGTGGTGGACGTGAGCCA
CGAAGACCCTGAGGTCAAGTTCAACTGGTACGTGGACGGCGTGGAGGT
GCATAATGCCAAGACAAAGCCGCGGGAGGAGCAGTACAACAGCACGT
ACCGTGTGGTCAGCGTCCTCACCGTCCTGCACCAGGACTGGCTGAATG
GCAAGGAGTACAAGTGCAAGGTCTCCAACAAAGCCCTCCCAGCCCCC
ATCGAGAAAACCATCTCCAAAGCCAAAGGGCAGCCCCGAGAACCACA
GGTGTACACCCTGCCCCCATCCCGGGAGGAGATGACCAAGAACCAGG
TCAGCCTGACCTGCCTGGTCAAAGGCTTCTATCCCAGCGACATCGCCG
TGGAGTGGGAGAGCAATGGGCAGCCGGAGAACAACTACAAGACCACG
CCTCCCGTGCTGGACTCCGACGGCTCCTTCTTCCTCTATAGCAAGCTCA
CCGTGGACAAGAGCAGGTGGCAGCAGGGGAACGTCTTCTCATGCTCCG
TGATGCATGAGGCTCTGCACAACCACTACACGCAGAAGAGCCTCTCCC
TGTCTCCGGGTAAATGA

4993_K13 (PGT-141) gamma heavy chain variable region nucleotide sequence:

(SEQ ID NO: 290)
CAGGTGCAGCTGGTGCAGTCTGGGCCTGAGGTGAAGAAGCCTGG
GTCCTCAGTGAAGGTCTCCTGCAAGGCCTCTGGAAACACCTTCAG
TAAATATGATGTCCACTGGGTACGGCAGGCCACTGGACAGGGGCT
TGAATGGGTGGGATGGATGAGTCATGAGGGTGATAAGACAGAATC
TGCACAGAGATTTAAGGGCCGAGTCACCTTCACGAGGGACACTTC
CGCAAGCACAGCCTACATGGAACTGCGCGGCCTGACATCTGACGA
CACGGCCATTTATTATTGTACGAGAGGCTCAAAACATCGCTTGCG
AGACTATGTTCTCTACGATGACTACGGCTTAATTAATTATCAAGAG
TGGAATGACTACCTTGAATTTTTGGACGTCTGGGGCCATGGAACC
GCGGTCACCGTCTCCTCA

4993_K13 (PGT-141) gamma heavy chain amino acid sequence: expressed protein with leader sequence in italics and variable region in bold.

(SEQ ID NO: 275)
*MDWIWRILFLVAAVASAHS***QVQLVQSGPEVKKPGSSVKVSCKASGNTFSK
YDVHWVRQATGQGLEWVGWMSHEGDKTESAQRFKGRVTFTRDTSA
STAYMELRGLTSDDTAIYYCTRGSKHRLRDYVLYDDYGLINYQEWND
YLEFLDVWGHGTAVTVSS**ASTKGPSVFPLAPSSKSTSGGTAALGCLVKD
YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK

4993_K13 (PGT-141) gamma heavy chain variable region amino acid sequence: (Kabat CDRs underlined, Chothia CDRs in bold italics)

(SEQ ID NO: 276)
QVQLVQSGPEVKKPGSSVKVSCKAS*GNTFSK*WVRQATGQGLEW

VG *WMSHEGDKTE*RVTFTRDTSASTAYMELRGLTSDDTAIY

YCTR*GSKHRLRDYVLYDDYGLINYQEWNDYLEFLDV*WGHGTAVTVSS

4993_K13 (PGT-141) gamma heavy chain Kabat CDRs:

(SEQ ID NO: 277)
CDR 1: KYDVH (SEQ ID NO: 278)
CDR 2: WMSHEGDKTESAQRFKG (SEQ ID NO: 279)
CDR 3: GSKHRLRDYVLYDDYGLINYQEWNDYLEFLDV

4993_K13 (PGT-141) gamma heavy chain Chothia CDRs:

(SEQ ID NO: 280)
CDR 1: GNTFSK (SEQ ID NO: 281)
CDR 2: WMSHEGDKTE (SEQ ID NO: 279)
CDR 3: GSKHRLRDYVLYDDYGLINYQEWNDYLEFLDV

4993_K13 (PGT-141) kappa light chain nucleotide sequence: coding sequence (variable region in bold)

(SEQ ID NO: 282)
ATGAGGCTCCCTGCTCAGCTCCTGGGGCTGCTAATGCTCTGGGTCTCTG

GATCCAGTGCGGATACTGTCGTGACTCAGTCTCCACTCTCCCTGCC

CGTCACCCCTGGAGAGGCGGCCTCCATGTCCTGTTCGTCGACTCA

GAGCCTCCGGCATAGTAATGGAGCCAACTATTTGGCTTGGTATCA

GCACAAACCGGGGCAGTCTCCACGACTCCTAATCCGTTTAGGTTC

TCAACGGGCCTCCGGGGTCCCTGACAGATTCAGTGGCAGTGGATC

AGGCACTCATTTTACACTGAAAATCAGTAGAGTGGAGGCTGAAGA

TGCTGCAATTTATTATTGCATGCAAGGTCTGAACCGTCCCTGGACG

TTCGGCAAGGGGACCAAGTTGGAAATCAAACGTACGGTGGCTGCAC

CATCTGTCTTCATCTTCCCGCCATCTGATGAGCAGTTGAAATCTGGAAC

TGCCTCTGTTGTGTGCCTGCTGAATAACTTCTATCCCAGAGAGGCCAAA

GTACAGTGGAAGGTGGATAACGCCCTCCAATCGGGTAACTCCCAGGAG

AGTGTCACAGAGCAGGACAGCAAGGACAGCACCTACAGCCTCAGCAG

CACCCTGACGCTGAGCAAAGCAGACTACGAGAAACACAAAGTCTACG

CCTGCGAAGTCACCCATCAGGGCCTGAGCTCGCCCGTCACAAAGAGCT

TCAACAGGGGAGAGTGTTAG

4993_K13 (PGT-141) kappa light chain variable region nucleotide sequence:

(SEQ ID NO: 283)
GATACTGTCGTGACTCAGTCTCCACTCTCCCTGCCCGTCACCCCTG

GAGAGGCGGCCTCCATGTCCTGTTCGTCGACTCAGAGCCTCCGGC

ATAGTAATGGAGCCAACTATTTGGCTTGGTATCAGCACAAACCGG

GGCAGTCTCCACGACTCCTAATCCGTTTAGGTTCTCAACGGGCCT

CCGGGGTCCCTGACAGATTCAGTGGCAGTGGATCAGGCACTCATT

TTACACTGAAAATCAGTAGAGTGGAGGCTGAAGATGCTGCAATTT

ATTATTGCATGCAAGGTCTGAACCGTCCCTGGACGTTCGGCAAGG

GGACCAAGTTGGAAATCAAA

4993_K13 (PGT-141) kappa light chain amino acid sequence: expressed protein with leader sequence in italics and variable region in bold.

(SEQ ID NO: 284)
*MRLPAQLLGLLMLWVSGSSA*DTVVTQSPLSLPVTPGEAASMSCSSTQSLR

HSNGANYLAWYQHKPGQSPRLLIRLGSQRASGVPDRFSGSGSGTHFT

LKISRVEAEDAAIYYCMQGLNRPWTFGKGTKLEIKRTVAAPSVFIFPPS

DEQLKSGTASVVCLLNNFYPREAKVQWKVDNALQSGNSQESVTEQDSKD

STYSLSSTLTLSKADYEKHKVYACEVTHQGLSSPVTKSFNRGEC

4993_K13 (PGT-141) kappa light chain variable region amino acid sequence: (Kabat CDRs underlined, Chothia CDRs in bold italics)

(SEQ ID NO: 285)
DTVVTQSPLSLPVTPGEAASMSC*SSTQSLRHSNGANYLA*WYQHKPGQ

SPRLLIR*LGSQRAS*GVPDRFSGSGSGTHFTLKISRVEAEDAAIYYC

*MQGLNRPWT*FGKGTKLEIK

4993_K13 (PGT-141) kappa light chain Kabat CDRs:

(SEQ ID NO: 286)
CDR 1: SSTQSLRHSNGANYLA (SEQ ID NO: 287)
CDR 2: LGSQRAS (SEQ ID NO: 288)
CDR 3: MQGLNRPWT

4993_K13 (PGT-141) kappa light chain Chothia CDRs:

(SEQ ID NO: 286)
CDR 1: SSTQSLRHSNGANYLA (SEQ ID NO: 287)
CDR 2: LGSQRAS

CDR 3: MQGLNRPWT (SEQ ID NO: 288)

4995_E20 (PGT-142) gamma heavy chain nucleotide sequence: coding sequence (variable region in bold)

(SEQ ID NO: 314)
ATGGACTGGATTTGGAGGATCCTCTTCTTGGTGGCAGCAGTTGCAAGT
GCCCACTCGCAGGTGCAGCTGGTGCAGTCTGGGCCTGAGGTGAAG
AAGCCTGGGTCCTCAGTGAAGGTCTCCTGCAAGGCCTCTGGAAAC
ACCTTCAGTAAATATGATGTCCACTGGGTACGACAGGCCACTGGA
CAGGGGCTTGAATGGGTGGGATGGATTAGTCATGAGCGTGATAAG
ACAGAATCTGCACAGAGATTTAAGGGCCGAGTCACCTTCACGAGG
GACACTTCCGCAACCACAGCCTACATGGAACTGCGCGGCCTGACA
TCTGACGACACGGCCATTTATTATTGTACGAGAGGCTCAAAACATC
GCTTGCGAGACTACGTTCTCTACGATGACTACGGCTTAATTAATTA
TCAAGAGTGGAATGACTACCTTGAATTTTTGGACGTCTGGGGCCA
TGGAACCGCGGTCACCGTCTCCTCAGCCTCCACCAAGGGCCCATCG
GTCTTCCCCCTGGCACCCTCCTCCAAGAGCACCTCTGGGGGCACAGCG
GCCCTGGGCTGCCTGGTCAAGGACTACTTCCCCGAACCGGTGACGGTG
TCGTGGAACTCAGGCGCCCTGACCAGCGGCGTGCACACCTTCCCGGCT
GTCCTACAGTCCTCAGGACTCTACTCCCTCAGCAGCGTGGTGACCGTG
CCCTCCAGCAGCTTGGGCACCCAGACCTACATCTGCAACGTGAATCAC
AAGCCCAGCAACACCAAGGTGGACAAGAGAGTTGAGCCCAAATCTTG
TGACAAAACTCACACATGCCCACCGTGCCCAGCACCTGAACTCCTGGG
GGGACCGTCAGTCTTCCTCTTCCCCCCAAAACCCAAGGACACCCTCAT
GATCTCCCGGACCCCTGAGGTCACATGCGTGGTGGTGGACGTGAGCCA
CGAAGACCCTGAGGTCAAGTTCAACTGGTACGTGGACGGCGTGGAGGT
GCATAATGCCAAGACAAAGCCGCGGGAGGAGCAGTACAACAGCACGT
ACCGTGTGGTCAGCGTCCTCACCGTCCTGCACCAGGACTGGCTGAATG
GCAAGGAGTACAAGTGCAAGGTCTCCAACAAAGCCCTCCCAGCCCCC
ATCGAGAAAACCATCTCCAAAGCCAAAGGGCAGCCCCGAGAACCACA
GGTGTACACCCTGCCCCCATCCCGGGAGGAGATGACCAAGAACCAGG
TCAGCCTGACCTGCCTGGTCAAAGGCTTCTATCCCAGCGACATCGCCG
TGGAGTGGGAGAGCAATGGGCAGCCGGAGAACAACTACAAGACCACG
CCTCCCGTGCTGGACTCCGACGGCTCCTTCTTCCTCTATAGCAAGCTCA
CCGTGGACAAGAGCAGGTGGCAGCAGGGGAACGTCTTCTCATGCTCCG
TGATGCATGAGGCTCTGCACAACCACTACACGCAGAAGAGCCTCTCCC
TGTCTCCGGGTAAATGA

4995_E20 (PGT-142) gamma heavy chain variable region nucleotide sequence:

(SEQ ID NO: 315)
CAGGTGCAGCTGGTGCAGTCTGGGCCTGAGGTGAAGAAGCCTGG
GTCCTCAGTGAAGGTCTCCTGCAAGGCCTCTGGAAACACCTTCAG
TAAATATGATGTCCACTGGGTACGACAGGCCACTGGACAGGGGCT
TGAATGGGTGGGATGGATTAGTCATGAGCGTGATAAGACAGAATC
TGCACAGAGATTTAAGGGCCGAGTCACCTTCACGAGGGACACTTC
CGCAACCACAGCCTACATGGAACTGCGCGGCCTGACATCTGACGA
CACGGCCATTTATTATTGTACGAGAGGCTCAAAACATCGCTTGCG
AGACTACGTTCTCTACGATGACTACGGCTTAATTAATTATCAAGAG
TGGAATGACTACCTTGAATTTTTGGACGTCTGGGGCCATGGAACC
GCGGTCACCGTCTCCTCA

4995_E20 (PGT-142) gamma heavy chain amino acid sequence: expressed protein with leader sequence in italics and variable region in bold.

(SEQ ID NO: 291)
*MDWIWRILFLVAAVASAHS*QVQLVQSGPEVKKPGSSVKVSCKASGNTFSK
YDVHWVRQATGQGLEWVGWISHERDKTESAQRFKGRVTFTRDTSAT
TAYMELRGLTSDDTAIYYCTRGSKHRLRDYVLYDDYGLINYQEWND
YLEFLDVWGHGTAVTVSSASTKGPSVFPLAPSSKSTSGGTAALGCLVKD
YFPEPVTVSWNSGALTSGVHTFPAVLQSSGLYSLSSVVTVPSSSLGTQTY
ICNVNHKPSNTKVDKRVEPKSCDKTHTCPPCPAPELLGGPSVFLFPPKPK
DTLMISRTPEVTCVVVDVSHEDPEVKFNWYVDGVEVHNAKTKPREEQYNS
TYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK

4995_E20 (PGT-142) gamma heavy chain variable region amino acid sequence: (Kabat CDRs underlined, Chothia CDRs in bold italics)

(SEQ ID NO: 292)
QVQLVQSGPEVKKPGSSVKVSCKAS*GNTFSK*<u>YDVHW</u>VRQATGQGLEW
VG*WISHERDKTE*<u>SAQRFKG</u>RVTFTRDTSATTAYMELRGLTSDDTAIY
YCTR*GSKHRLRDYVLYDDYGLINYQEWNDYLEFLDV*WGHGTAVTVSS

4995_E20 (PGT-142) gamma heavy chain Kabat CDRs:

(SEQ ID NO: 277)
CDR 1: KYDVH (SEQ ID NO: 293)
CDR 2: WISHERDKTESAQRFKG (SEQ ID NO: 279)
CDR 3: GSKHRLRDYVLYDDYGLINYQEWNDYLEFLDV

4995_E20 (PGT-142) gamma heavy chain Chothia CDRs:

(SEQ ID NO: 280)
CDR 1: GNTFSK (SEQ ID NO: 294)
CDR 2: WISHERDKTE (SEQ ID NO: 279)
CDR 3: GSKHRLRDYVLYDDYGLINYQEWNDYLEFLDV

4995_E20 (PGT-142) kappa light chain nucleotide sequence: coding sequence (variable region in bold)

(SEQ ID NO: 282)
ATGAGGCTCCCTGCTCAGCTCCTGGGGCTGCTAATGCTCTGGGTCTCTG
GATCCAGTGCGGATACTGTCGTGACTCAGTCTCCACTCTCCCTGCC
CGTCACCCCTGGAGAGGCGGCCTCCATGTCCTGTTCGTCGACTCA
GAGCCTCCGGCATAGTAATGGAGCCAACTATTTGGCTTGGTATCA
GCACAAACCGGGGCAGTCTCCACGACTCCTAATCCGTTTAGGTTC
TCAACGGGCCTCCGGGGTCCCTGACAGATTCAGTGGCAGTGGATC
AGGCACTCATTTTACACTGAAAATCAGTAGAGTGGAGGCTGAAGA
TGCTGCAATTTATTATTGCATGCAAGGTCTGAACCGTCCCTGGACG
TTCGGCAAGGGGACCAAGTTGGAAATCAAACGTACGGTGGCTGCAC
CATCTGTCTTCATCTTCCCGCCATCTGATGAGCAGTTGAAATCTGGAAC
TGCCTCTGTTGTGTGCCTGCTGAATAACTTCTATCCCAGAGAGGCCAAA
GTACAGTGGAAGGTGGATAACGCCCTCCAATCGGGTAACTCCCAGGAG
AGTGTCACAGAGCAGGACAGCAAGGACAGCACCTACAGCCTCAGCAG
CACCCTGACGCTGAGCAAAGCAGACTACGAGAAACACAAAGTCTACG
CCTGCGAAGTCACCCATCAGGGCCTGAGCTCGCCCGTCACAAAGAGCT
TCAACAGGGGAGAGTGTTAG

4995_E20 (PGT-142) kappa light chain variable region nucleotide sequence:

(SEQ ID NO: 283)
GATACTGTCGTGACTCAGTCTCCACTCTCCCTGCCCGTCACCCCTG
GAGAGGCGGCCTCCATGTCCTGTTCGTCGACTCAGAGCCTCCGGC
ATAGTAATGGAGCCAACTATTTGGCTTGGTATCAGCACAAACCGG
GGCAGTCTCCACGACTCCTAATCCGTTTAGGTTCTCAACGGGCCT
CCGGGGTCCCTGACAGATTCAGTGGCAGTGGATCAGGCACTCATT
TTACACTGAAAATCAGTAGAGTGGAGGCTGAAGATGCTGCAATTT
ATTATTGCATGCAAGGTCTGAACCGTCCCTGGACGTTCGGCAAGG
GGACCAAGTTGGAAATCAAA

4995_E20 (PGT-142) kappa light chain amino acid sequence: expressed protein with leader sequence in italics and variable region in bold.

(SEQ ID NO: 284)
*MRLPAQLLGLLMLWVSGSSA*DTVVTQSPLSLPVTPGEAASMSCSSTQSLR
HSNGANYLAWYQHKPGQSPRLLIRLGSQRASGVPDRFSGSGSGTHFT
LKISRVEAEDAAIYYCMQGLNRPWTFGKGTKLEIKRTVAAPSVFIFPPS
DEQLKSGTASVVCLLNNFYPREAKVQWKVDNALQSGNSQESVTEQDSKD
STYSLSSTLTLSKADYEKHKVYACEVTHQGLSSPVTKSFNRGEC

4995_E20 (PGT-142) kappa light chain variable region amino acid sequence: (Kabat CDRs underlined, Chothia CDRs in bold italics)

(SEQ ID NO: 285)
DTVVTQSPLSLPVTPGEAASMSC*SSTQSLRHSNGANYLA*
WYQHKPGQSPRLLIR*LGSQRAS*GVPDRFSGSGSGTHF
TLKISRVEAEDAAIYYC*MQGLNRPWT*FGKGTKLEIK

4995_E20 (PGT-142) kappa light chain Kabat CDRs:

(SEQ ID NO: 286)
CDR 1: SSTQSLRHSNGANYLA (SEQ ID NO: 287)
CDR 2: LGSQRAS (SEQ ID NO: 288)
CDR 3: MQGLNRPWT

4995_E20 (PGT-142) kappa light chain Chothia CDRs:

(SEQ ID NO: 286)
CDR 1: SSTQSLRHSNGANYLA (SEQ ID NO: 287)
CDR 2: LGSQRAS (SEQ ID NO: 288)
CDR 3: MQGLNRPWT

4980_N08 (PGT-143) gamma heavy chain nucleotide sequence: coding sequence (variable region in bold)

(SEQ ID NO: 295)
ATGGACTGGATTTGGAGGATCCTCTTCTTGGTGGCAGCAGTTGCAAGT
GCCCACGCGCAGGTGCAGCTGGAGCAGTCTGGGGCTGAGGTGAAG
AAGCCTGGGTCCTCAGTGAAGGTCTCCTGCAAGGCCTCTGGAAAC
ACCTTCAGTAAATATGATGTCCACTGGGTACGACAGGCCACTGGA
CAGGGGCTTGAATGGGTGGGATGGATGAGTCATGAGGGTGATAA
GACAGAATCTGCACAGAGATTTAAGGGGCGAGTCACCTTCACGAG
GGACACTTCCGCAAGCACAGCCTACATGGAACTGCGCGGCCTGAC
ATCTGACGACACGGCCATTTATTATTGTACGAGAGGTTCAAAACAT
CGCTTGCGAGACTACGTTCTCTACGATGACTACGGCTTAATTAATT
ATCAAGAGTGGAATGACTACCTTGAATTTTTGGACGTCTGGGGCC
ATGGAACCGCGGTCACCGTCTCCTCAGCCTCCACCAAGGGCCCATC
GGTCTTCCCCCTGGCACCCTCCTCCAAGAGCACCTCTGGGGGCACAGC
GGCCCTGGGCTGCCTGGTCAAGGACTACTTCCCCGAACCGGTGACGGT
GTCGTGGAACTCAGGCGCCCTGACCAGCGGCGTGCACACCTTCCCGGC
TGTCCTACAGTCCTCAGGACTCTACTCCCTCAGCAGCGTGGTGACCGTG
CCCTCCAGCAGCTTGGGCACCCAGACCTACATCTGCAACGTGAATCAC
AAGCCCAGCAACACCAAGGTGGACAAGAGAGTTGAGCCCAAATCTTG
TGACAAAACTCACACATGCCCACCGTGCCCAGCACCTGAACTCCTGGG
GGGACCGTCAGTCTTCCTCTTCCCCCCAAAACCCAAGGACACCCTCAT
GATCTCCCGGACCCCTGAGGTCACATGCGTGGTGGTGGACGTGAGCCA
CGAAGACCCTGAGGTCAAGTTCAACTGGTACGTGGACGGCGTGGAGGT
GCATAATGCCAAGACAAAGCCGCGGGAGGAGCAGTACAACAGCACGT

ACCGTGTGGTCAGCGTCCTCACCGTCCTGCACCAGGACTGGCTGAATG

GCAAGGAGTACAAGTGCAAGGTCTCCAACAAAGCCCTCCCAGCCCCC

ATCGAGAAAACCATCTCCAAAGCCAAAGGGCAGCCCCGAGAACCACA

GGTGTACACCCTGCCCCCATCCCGGGAGGAGATGACCAAGAACCAGG

TCAGCCTGACCTGCCTGGTCAAAGGCTTCTATCCCAGCGACATCGCCG

TGGAGTGGGAGAGCAATGGGCAGCCGGAGAACAACTACAAGACCACG

CCTCCCGTGCTGGACTCCGACGGCTCCTTCTTCCTCTATAGCAAGCTCA

CCGTGGACAAGAGCAGGTGGCAGCAGGGGAACGTCTTCTCATGCTCCG

TGATGCATGAGGCTCTGCACAACCACTACACGCAGAAGAGCCTCTCCC

TGTCTCCGGGTAAATGA

4980_N08 (PGT-143) gamma heavy chain variable region nucleotide sequence:

(SEQ ID NO: 296)
CAGGTGCAGCTGGAGCAGTCTGGGGCTGAGGTGAAGAAGCCTGG

GTCCTCAGTGAAGGTCTCCTGCAAGGCCTCTGGAAACACCTTCAG

TAAATATGATGTCCACTGGGTACGACAGGCCACTGGACAGGGGCT

TGAATGGGTGGGATGGATGAGTCATGAGGGTGATAAGACAGAATC

TGCACAGAGATTTAAGGGGCGAGTCACCTTCACGAGGGACACTTC

CGCAAGCACAGCCTACATGGAACTGCGCGGCCTGACATCTGACGA

CACGGCCATTTATTATTGTACGAGAGGTTCAAAACATCGCTTGCGA

GACTACGTTCTCTACGATGACTACGGCTTAATTAATTATCAAGAGT

GGAATGACTACCTTGAATTTTTGGACGTCTGGGGCCATGGAACCG

CGGTCACCGTCTCCTCA

4980_N08 (PGT-143) gamma heavy chain amino acid sequence: expressed protein with leader sequence in italics and variable region in bold.

(SEQ ID NO: 297)
*MDWIWRILFLVAAVASAHA*QVQLEQSGAEVKKPGSSVKVSCKASGNTFS

KYDVHWVRQATGQGLEWVGWMSHEGDKTESAQRFKGRVTFTRDTS

ASTAYMELRGLTSDDTAIYYCTRGSKHRLRDYVLYDDYGLINYQEWN

DYLEFLDVWGHGTAVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYN

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLSPGK

4980_N08 (PGT-143) gamma heavy chain variable region amino acid sequence: (Kabat CDRs underlined, Chothia CDRs in bold italics)

(SEQ ID NO: 298)
QVQLEQSGAEVKKPGSSVKVSCKAS*GNTFSK*<u>YDVH</u>WVRQATGQGLEW

VG *WMSHEGDKTE*<u>SAQRFKG</u>RVTFTRDTSASTAYMELRGLTSDDTAIY

YCTR<u>GSKHRLRDYVLYDDYGLINYQEWNDYLEFLDV</u>

WGHGTAVTVSS

4980_N08 (PGT-143) gamma heavy chain Kabat CDRs:

(SEQ ID NO: 277)
CDR 1: KYDVH (SEQ ID NO: 278)
CDR 2: WMSHEGDKTESAQRFKG (SEQ ID NO: 279)
CDR 3: GSKHRLRDYVLYDDYGLINYQEWNDYLEFLDV

4980_N08 (PGT-143) gamma heavy chain Chothia CDRs:

(SEQ ID NO: 280)
CDR 1: GNTFSK (SEQ ID NO: 281)
CDR 2: WMSHEGDKTE (SEQ ID NO: 279)
CDR 3: GSKHRLRDYVLYDDYGLINYQEWNDYLEFLDV

4980_N08 (PGT-143) kappa light chain nucleotide sequence: coding sequence (variable region in bold)

(SEQ ID NO: 299)
ATGAGGCTCCCTGCTCAGCTCCTGGGGCTGCTAATGCTCTGGGTCTCTG

GATCCAGTGCGGATACTGTCGTGACTCAGTCTCCACTCTCCCTGCC

CGTCACCCCTGGAGAGGCGGCCTCCATGTCCTGTACGTCGACTCA

GAGCCTCCGTCATAGTAATGGAGCCAACTATTTGGCTTGGTACCA

GCACAAACCAGGGCAGTCTCCACGACTCCTAATCCGTTTAGGTTC

TCAACGGGCCTCCGGGGTCCCTGACAGATTCAGTGGCAGTGGATC

AGGCACTCATTTTACACTGAAAATCAGTCGAGTGGAGCCTGAAGA

TGCTGCAATTTATTATTGCATGCAAGGTCTGAACCGTCCCTGGACG

TTCGGCAAGGGGACCAAGTTGGAAATCAAACGTACGGTGGCTGCAC

CATCTGTCTTCATCTTCCCGCCATCTGATGAGCAGTTGAAATCTGGAAC

TGCCTCTGTTGTGTGCCTGCTGAATAACTTCTATCCCAGAGAGGCCAAA

GTACAGTGGAAGGTGGATAACGCCCTCCAATCGGGTAACTCCCAGGAG

AGTGTCACAGAGCAGGACAGCAAGGACAGCACCTACAGCCTCAGCAG

CACCCTGACGCTGAGCAAAGCAGACTACGAGAAACACAAAGTCTACG

CCTGCGAAGTCACCCATCAGGGCCTGAGCTCGCCCGTCACAAAGAGCT

TCAACAGGGGAGAGTGTTAG

4980_N08 (PGT-1431) kappa light chain variable region nucleotide sequence:

(SEQ ID NO: 300)
GATACTGTCGTGACTCAGTCTCCACTCTCCCTGCCCGTCACCCCTG

GAGAGGCGGCCTCCATGTCCTGTACGTCGACTCAGAGCCTCCGTC

```
ATAGTAATGGAGCCAACTATTTGGCTTGGTACCAGCACAAACCAG

GGCAGTCTCCACGACTCCTAATCCGTTTAGGTTCTCAACGGGCCT

CCGGGGTCCCTGACAGATTCAGTGGCAGTGGATCAGGCACTCATT

TTACACTGAAAATCAGTCGAGTGGAGCCTGAAGATGCTGCAATTT

ATTATTGCATGCAAGGTCTGAACCGTCCCTGGACGTTCGGCAAGG

GGACCAAGTTGGAAATCAAA
```

4980_N08 (PGT-143) kappa light chain amino acid sequence: expressed protein with leader sequence in italics and variable region in bold.

(SEQ ID NO: 301)
*MRLPAQLLGLLMLWVSGSSA*DTVVTQSPLSLPVTPGEAASMSCTSTQSL

RHSNGANYLAWYQHKPGQSPRLLIRLGSQRASGVPDRFSGSGSGTHFT

LKISRVEPEDAAIYYCMQGLNRPWTFGKGTKLEIKRTVAAPSVFIFPPS

DEQLKSGTASVVCLLNNFYPREAKVQWKVDNALQSGNSQESVTEQDSKD

STYSLSSTLTLSKADYEKHKVYACEVTHQGLSSPVTKSFNRGEC

4980_N08 (PGT-143) kappa light chain variable region amino acid sequence: (Kabat CDRs underlined, Chothia CDRs in bold italics)

(SEQ ID NO: 302)
DTVVTQSPLSLPVTPGEAASMSC*TSTQSLRHSNGANYLA*WYQHKPGQSPR

LLIR*LGSQRAS*GVPDRFSGSGSGTHFTLKISRVEPEDAAIYYC

*MQGLNRPWT*FGKGTKLEIK

4980_N08 (PGT-143) kappa light chain Kabat CDRs:

```
    CDR 1:
                              (SEQ ID NO: 303)
        TSTQSLRHSNGANYLA

CDR 2:
                              (SEQ ID NO: 287)
        LGSQRAS

CDR 3:
                              (SEQ ID NO: 288)
        MQGLNRPWT
```

4980_N08 (PGT-143) kappa light chain Chothia CDRs:
CDR 1: TSTQSLRHSNGANYLA (SEQ ID NO: 303)
CDR 2: LGSQRAS (SEQ ID NO: 287)
CDR 3: MQGLNRPWT (SEQ ID NO: 288)

4970_K22 (PGT-144) gamma heavy chain nucleotide sequence: coding sequence (variable region in bold)

(SEQ ID NO: 304)
ATGGACTGGATTTGGAGGATCCTCTTCTTGGTGGCAGCAGTTGCAAGT

GCCCACTCGCAGGTGCAGCTGGTGCAGTCTGGGGCTGAGGTGAAG

AAGCCTGGGTCCTCAGTGAAGGTCTCCTGCAAGGCCTCTGGAAAC

ACCTTCAGGAAATATGATGTCCACTGGGTACGACAGGCCACTGGA

CAGGGGCTTGAATGGGTGGGATGGATGAGTCATGAGGGTGATAA

GACAGAATCTGCACAGAGATTTAAGGGCCGAGTCTCTTTCACGAG

```
GGACAATTCCGCAAGCACAGCCTACATTGAACTGCGCGGCCTGAC

ATCTGACGACACGGCCATTTATTATTGTACCGGAGGCTCAAAACAT

CGCTTGCGAGACTACGTTCTCTACGATGATTACGGCCTAATAAATC

AGCAAGAGTGGAATGACTACCTTGAATTTTTGGACGTCTGGGGCC

ATGGAACCGCGGTCACCGTCTCCTCAGCCTCCACCAAGGGCCCATC

GGTCTTCCCCCTGGCACCCTCCTCCAAGAGCACCTCTGGGGGCACAGC

GGCCCTGGGCTGCCTGGTCAAGGACTACTTCCCCGAACCGGTGACGGT

GTCGTGGAACTCAGGCGCCCTGACCAGCGGCGTGCACACCTTCCCGGC

TGTCCTACAGTCCTCAGGACTCTACTCCCTCAGCAGCGTGGTGACCGTG

CCCTCCAGCAGCTTGGGCACCCAGACCTACATCTGCAACGTGAATCAC

AAGCCCAGCAACACCAAGGTGGACAAGAGAGTTGAGCCCAAATCTTG

TGACAAAACTCACACATGCCCACCGTGCCCAGCACCTGAACTCCTGGG

GGGACCGTCAGTCTTCCTCTTCCCCCCAAAACCCAAGGACACCCTCAT

GATCTCCCGGACCCCTGAGGTCACATGCGTGGTGGTGGACGTGAGCCA

CGAAGACCCTGAGGTCAAGTTCAACTGGTACGTGGACGGCGTGGAGGT

GCATAATGCCAAGACAAAGCCGCGGGAGGAGCAGTACAACAGCACGT

ACCGTGTGGTCAGCGTCCTCACCGTCCTGCACCAGGACTGGCTGAATG

GCAAGGAGTACAAGTGCAAGGTCTCCAACAAAGCCCTCCCAGCCCCC

ATCGAGAAAACCATCTCCAAAGCCAAAGGGCAGCCCCGAGAACCACA

GGTGTACACCCTGCCCCCATCCCGGGAGGAGATGACCAAGAACCAGG

TCAGCCTGACCTGCCTGGTCAAAGGCTTCTATCCCAGCGACATCGCCG

TGGAGTGGGAGAGCAATGGGCAGCCGGAGAACAACTACAAGACCACG

CCTCCCGTGCTGGACTCCGACGGCTCCTTCTTCCTCTATAGCAAGCTCA

CCGTGGACAAGAGCAGGTGGCAGCAGGGGAACGTCTTCTCATGCTCCG

TGATGCATGAGGCTCTGCACAACCACTACACGCAGAAGAGCCTCTCCC

TGTCTCCGGGTAAATGA
```

4970_K22 (PGT-144) gamma heavy chain variable region nucleotide sequence:

(SEQ ID NO: 305)
```
CAGGTGCAGCTGGTGCAGTCTGGGGCTGAGGTGAAGAAGCCTGG

GTCCTCAGTGAAGGTCTCCTGCAAGGCCTCTGGAAACACCTTCAG

GAAATATGATGTCCACTGGGTACGACAGGCCACTGGACAGGGGCT

TGAATGGGTGGGATGGATGAGTCATGAGGGTGATAAGACAGAATC

TGCACAGAGATTTAAGGGCCGAGTCTCTTTCACGAGGGACAATTC

CGCAAGCACAGCCTACATTGAACTGCGCGGCCTGACATCTGACGA

CACGGCCATTTATTATTGTACCGGAGGCTCAAAACATCGCTTGCG

AGACTACGTTCTCTACGATGATTACGGCCTAATAAATCAGCAAGA

GTGGAATGACTACCTTGAATTTTTGGACGTCTGGGGCCATGGAAC

CGCGGTCACCGTCTCCTCA
```

4970_K22 (PGT-144) gamma heavy chain amino acid sequence: expressed protein with leader sequence in italics and variable region in bold.

(SEQ ID NO: 306)
MDWIWRILFLVAAVASAHSQVQLVQSGAEVKKPGSSVKVSCKASGNTFR

KYDVHWVRQATGQGLEWVGWMSHEGDKTESAQRFKGRVSFTRDNS

ASTAYIELRGLTSDDTAIYYCTGGSKHRLRDYVLYDDYGLINQQEWN

DYLEFLDVWGHGTAVTVSSASTKGPSVFPLAPSSKSTSGGTAALGCLVK

DYFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPKD

TLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK

4970_K22 (PGT-144) gamma heavy chain variable region amino acid sequence:
(Kabat CDRs underlined, Chothia CDRs in bold italics)

(SEQ ID NO: 307)
QVQLVQSGAEVKKPGSSVKVSCKAS*GNTFRK*YDVHWVRQATGQGLEW

VG*WMSHEGDKTE*SAQRFKGRVSFTRDNSASTAYIELRGLTSDDTAIYYC

TG*GSKHRLRDYVLYDDYGLINQQEWNDYLEFLDV*WGHGTAVTVSS

4970_K22 (PGT-144) gamma heavy chain Kabat CDRs:

CDR 1:
(SEQ ID NO: 277)
KYDVH

CDR 2:
(SEQ ID NO: 278)
WMSHEGDKTESAQRFKG

CDR 3:
(SEQ ID NO: 308)
GSKHRLRDYVLYDDYGLINQQEWNDYLEFLDV

4970_K22 (PGT-144) gamma heavy chain Chothia CDRs:

CDR 1:
(SEQ ID NO: 309)
GNTFRK

CDR 2:
(SEQ ID NO: 281)
WMSHEGDKTE

CDR 3:
(SEQ ID NO: 308)
GSKHRLRDYVLYDDYGLINQQEWNDYLEFLDV

4970_K22 (PGT-144) kappa light chain nucleotide sequence: coding sequence (variable region in bold)

(SEQ ID NO: 310)
ATGAGGCTCCCTGCTCAGCTCCTGGGGCTGCTAATGCTCTGGGTCTCTG

GATCCAGTGCGGATACTGTCGTGACTCAGTCTCCACTCTCCCTGTC

CGTCACCCCTGGAGAGGCGGCCTCCATGTCCTGTACGTCGACTCA

GAGCCTCCGGCATAGTAATGGAGCCAACTATTTGGCTTGGTACCA

GCACAAACCAGGGCAGTCTCCACGACTCCTAATCCGTTTAGGTTC

TCAACGGGCCTCCGGGGTCCCTGACAGATTCAGTGGCAGTGGATC

AGGCACTCATTTTACACTGAAAATCAGTAGAGTGGAGGCTGACGA

TGCTGCAATTTATTATTGCATGCAAGGTCTGAACCGTCCCTGGACG

TTCGGCAAGGGGACCAAGTTGGAGATCAAACGTACGGTGGCTGCAC

CATCTGTCTTCATCTTCCCGCCATCTGATGAGCAGTTGAAATCTGGAAC

TGCCTCTGTTGTGTGCCTGCTGAATAACTTCTATCCCAGAGAGGCCAAA

GTACAGTGGAAGGTGGATAACGCCCTCCAATCGGGTAACTCCCAGGAG

AGTGTCACAGAGCAGGACAGCAAGGACAGCACCTACAGCCTCAGCAG

CACCCTGACGCTGAGCAAAGCAGACTACGAGAAACACAAAGTCTACG

CCTGCGAAGTCACCCATCAGGGCCTGAGCTCGCCCGTCACAAAGAGCT

TCAACAGGGGAGAGTGTTAG

4970_K22 (PGT-144) kappa light chain variable region nucleotide sequence:

(SEQ ID NO: 311)
GATACTGTCGTGACTCAGTCTCCACTCTCCCTGTCCGTCACCCCTG

GAGAGGCGGCCTCCATGTCCTGTACGTCGACTCAGAGCCTCCGGC

ATAGTAATGGAGCCAACTATTTGGCTTGGTACCAGCACAAACCAG

GGCAGTCTCCACGACTCCTAATCCGTTTAGGTTCTCAACGGGCCT

CCGGGGTCCCTGACAGATTCAGTGGCAGTGGATCAGGCACTCATT

TTACACTGAAAATCAGTAGAGTGGAGGCTGACGATGCTGCAATTT

ATTATTGCATGCAAGGTCTGAACCGTCCCTGGACGTTCGGCAAGG

GGACCAAGTTGGAGATCAAA

4970_K22 (PGT-144) kappa light chain amino acid sequence: expressed protein with leader sequence in italics and variable region in bold.

(SEQ ID NO: 312)
*MRLPAQLLGLLMLWVSGSSA*DTVVTQSPLSLSVTPGEAASMSCTSTQSLR

HSNGANYLAWYQHKPGQSPRLLIRLGSQRASGVPDRFSGSGSGTHFT

LKISRVEADDAAIYYCMQGLNRPWTFGKGTKLEIKRTVAAPSVFIFPPS

DEQLKSGTASVVCLLNNFYPREAKVQWKVDNALQSGNSQESVTEQDSKD

STYSLSSTLTLSKADYEKHKVYACEVTHQGLSSPVTKSFNRGEC

4970_K22 (PGT-144) kappa light chain variable region amino acid sequence: (Kabat CDRs underlined, Chothia CDRs in bold italics)

(SEQ ID NO: 313)
DTVVTQSPLSLSVTPGEAASMSC*TSTQSLRHSNGANYLA*WYQHK

PGQSPRLLIR*LGSQRAS*GVPDRFSGSGSGTHFTLKISRVEADDAAI

YYC*MQGLNRPWT*FGKGTKLEIK

4970_K22 (PGT-144) kappa light chain Kabat CDRs:

CDR 1:
(SEQ ID NO: 303)
TSTQSLRHSNGANYLA

-continued

```
CDR 2:
                                      (SEQ ID NO: 287)
LGSQRAS

CDR 3:
                                      (SEQ ID NO: 288)
MQGLNRPWT
```

4970_K22 (PGT-144) kappa light chain Chothia CDRs:

```
                                      (SEQ ID NO: 303)
CDR 1: TSTQSLRHSNGANYLA (SEQ ID NO: 287)
CDR 2: LGSQRAS (SEQ ID NO: 288)
CDR 3: MQGLNRPWT
```

The 4838_L06 (PGT-121) antibody includes a heavy chain variable region (SEQ ID NO: 79), encoded by the nucleic acid sequence shown in SEQ ID NO: 63, and a light chain variable region (SEQ ID NO: 149) encoded by the nucleic acid sequence shown in SEQ ID NO: 147.

The heavy chain CDRs of the 4838_L06 (PGT-121) antibody have the following sequences per Kabat definition: DSYWS (SEQ ID NO: 90), YVHKSGDTNYSPSLKS (SEQ ID NO: 265), and TLHGRRIYGIVAFNEWFTYFYMDV (SEQ ID NO: 143). The light chain CDRs of the 4838_L06 (PGT-121) antibody have the following sequences per Kabat definition: GEKSLGSRAVQ (SEQ ID NO: 150), NNQDRPS (SEQ ID NO: 151), and HIWDSRVPTKWV (SEQ ID NO: 152).

The heavy chain CDRs of the 4838_L06 (PGT-121) antibody have the following sequences per Chothia definition: GASISD (SEQ ID NO: 144), YVHKSGDTN (SEQ ID NO: 145), and TLHGRRIYGIVAFNEWFTYFYMDV (SEQ ID NO: 143). The light chain CDRs of the 4838_L06 (PGT-121) antibody have the following sequences per Chothia definition: GEKSLGSRAVQ (SEQ ID NO: 150), NNQDRPS (SEQ ID NO: 151), and HIWDSRVPTKWV (SEQ ID NO: 152).

The 4873_E03 (PGT-121) antibody includes a heavy chain variable region (SEQ ID NO: 79), encoded by the nucleic acid sequence shown in SEQ ID NO: 63, and a light chain variable region (SEQ ID NO: 149) encoded by the nucleic acid sequence shown in SEQ ID NO: 147.

The heavy chain CDRs of the 4873_E03 (PGT-121) antibody have the following sequences per Kabat definition: DSYWS (SEQ ID NO: 90), YVHKSGDTNYSPSLKS (SEQ ID NO: 265), and TLHGRRIYGIVAFNEWFTYFYMDV (SEQ ID NO: 143). The light chain CDRs of the 4873_E03 (PGT-121) antibody have the following sequences per Kabat definition: GEKSLGSRAVQ (SEQ ID NO: 150), NNQDRPS (SEQ ID NO: 151), and HIWDSRVPTKWV (SEQ ID NO: 152).

The heavy chain CDRs of the 4873_E03 (PGT-121) antibody have the following sequences per Chothia definition: GASISD (SEQ ID NO: 144), YVHKSGDTN (SEQ ID NO: 145), and TLHGRRIYGIVAFNEWFTYFYMDV (SEQ ID NO: 143). The light chain CDRs of the 4873_E03 (PGT-121) antibody have the following sequences per Chothia definition: GEKSLGSRAVQ (SEQ ID NO: 150), NNQDRPS (SEQ ID NO: 151), and HIWDSRVPTKWV (SEQ ID NO: 152).

The 4877_D15 (PGT-122) antibody includes a heavy chain variable region (SEQ ID NO: 156), encoded by the nucleic acid sequence shown in SEQ ID NO: 154, and a light chain variable region (SEQ ID NO: 161) encoded by the nucleic acid sequence shown in SEQ ID NO: 159.

The heavy chain CDRs of the 4877_D15 (PGT-122) antibody have the following sequences per Kabat definition: DNYWS (SEQ ID NO: 261), YVHDSGDTNYNPSLKS (SEQ ID NO: 157), and TKHGRRIYGVVAFKEWFTYFYMDV (SEQ ID NO: 262). The light chain CDRs of the 4877_D15 (PGT-122) antibody have the following sequences per Kabat definition: GEESLGSRSVI (SEQ ID NO: 162), NNNDRPS (SEQ ID NO: 163), and HIWDSRRPTNWV (SEQ ID NO: 164).

The heavy chain CDRs of the 4877_D15 (PGT-122) antibody have the following sequences per Chothia definition: GTLVRD (SEQ ID NO: 263), YVHDSGDTN (SEQ ID NO: 264), and TKHGRRIYGVVAFKEWFTYFYMDV (SEQ ID NO: 262). The light chain CDRs of the 4877_D15 (PGT-122) antibody have the following sequences per Chothia definition: GEESLGSRSVI (SEQ ID NO: 162), NNNDRPS (SEQ ID NO: 163), and HIWDSRRPTNWV (SEQ ID NO: 164).

The 4858_P08 (PGT-123) antibody includes a heavy chain variable region (SEQ ID NO: 168), encoded by the nucleic acid sequence shown in SEQ ID NO: 166, and a light chain variable region (SEQ ID NO: 177) encoded by the nucleic acid sequence shown in SEQ ID NO: 175.

The heavy chain CDRs of the 4858_P08 (PGT-123) antibody have the following sequences per Kabat definition: DAYWS (SEQ ID NO: 169), YVHHSGDTNYNPSLKR (SEQ ID NO: 170), ALHGKRIYGIVALGELFTYFYMDV (SEQ ID NO: 171). The light chain CDRs of the 4858_P08 (PGT-123) antibody have the following sequences per Kabat definition: GKESIGSRAVQ (SEQ ID NO: 178), NNQDRPA (SEQ ID NO: 179), and HIYDARGGTNWV (SEQ ID NO: 180).

The heavy chain CDRs of the 4858_P08 (PGT-123) antibody have the following sequences per Chothia definition: GASIND (SEQ ID NO: 172), YVHHSGDTN (SEQ ID NO: 173), ALHGKRIYGIVALGELFTYFYMDV (SEQ ID NO: 171). The light chain CDRs of the 4858_P08 (PGT-123) antibody have the following sequences per Chothia definition: GKESIGSRAVQ (SEQ ID NO: 178), NNQDRPA (SEQ ID NO: 179), HIYDARGGTNWV (SEQ ID NO: 180).

The 5123_A06 (PGT-125) antibody includes a heavy chain variable region (SEQ ID NO: 164), encoded by the nucleic acid sequence shown in SEQ ID NO: 182, and a light chain variable region (SEQ ID NO: 193) encoded by the nucleic acid sequence shown in SEQ ID NO: 191.

The heavy chain CDRs of the 5123_A06 (PGT-125) antibody have the following sequences per Kabat definition: ACTYFWG (SEQ ID NO: 185), SLSHCQSFWGSGWT-FHNPSLKS (SEQ ID NO: 186), and FDGEVLVYNHWP-KPAWVDL (SEQ ID NO: 187). The light chain CDRs of the 5123_A06 (PGT-125) antibody have the following sequences per Kabat definition: NGTATNFVS (SEQ ID NO: 194), GVDKRPP (SEQ ID NO: 195), and GSLVGNWDVI (SEQ ID NO: 196).

The heavy chain CDRs of the 5123_A06 (PGT-125) antibody have the following sequences per Chothia definition: GESTGACT (SEQ ID NO: 188), SLSHCQSFWGS-GWTF (SEQ ID NO: 189), and FDGEVLVYNHWPK-PAWVDL (SEQ ID NO: 187). The light chain CDRs of the 5123_A06 (PGT-125) antibody have the following sequences per Chothia definition: NGTATNFVS (SEQ ID NO: 194), GVDKRPP (SEQ ID NO: 195), and GSLVGN-WDVI (SEQ ID NO: 196).

The 5141_B17 (PGT-126) antibody includes a heavy chain variable region (SEQ ID NO: 200), encoded by the nucleic acid sequence shown in SEQ ID NO: 198, and a light chain variable region (SEQ ID NO: 209) encoded by the nucleic acid sequence shown in SEQ ID NO: 207.

The heavy chain CDRs of the 5141_B17 (PGT-126) antibody have the following sequences per Kabat definition: ACDYFWG (SEQ ID NO: 201), GLSHCAGYYNTGWT-YHNPSLKS (SEQ ID NO: 202), and FDGEVLVYHDWP-KPAWVDL (SEQ ID NO: 203). The light chain CDRs of the 5141_B17 (PGT-126) antibody have the following sequences per Kabat definition: TGTSNRFVS (SEQ ID NO: 210), GVNKRPS (SEQ ID NO: 211), and SSLVGNWDVI (SEQ ID NO: 212).

The heavy chain CDRs of the 5141_B17 (PGT-126) antibody have the following sequences per Chothia definition: GDSTAACD (SEQ ID NO: 204), GLSHCAGYYNT-GWTY (SEQ ID NO: 205), and FDGEVLVYHDWPK-PAWVDL (SEQ ID NO: 203). The light chain CDRs of the 5141_B17 (PGT-126) antibody have the following sequences per Chothia definition: TGTSNRFVS (SEQ ID NO: 210), GVNKRPS (SEQ ID NO: 211), and SSLVGN-WDVI (SEQ ID NO: 212).

The 5147_N06 (PGT-130) antibody includes a heavy chain variable region (SEQ ID NO: 216), encoded by the nucleic acid sequence shown in SEQ ID NO: 214, and a light chain variable region (SEQ ID NO: 225) encoded by the nucleic acid sequence shown in SEQ ID NO: 223.

The heavy chain CDRs of the 5147_N06 (PGT-130) antibody have the following sequences per Kabat definition: TGHYYWG (SEQ ID NO: 217), HIHYTTAVLHNPSLKS (SEQ ID NO: 218), and SGGDILYYYEWQKPHWFSP (SEQ ID NO: 219). The light chain CDRs of the 5147_N06 (PGT-130) antibody have the following sequences per Kabat definition: NGTSSDIGGWNFVS (SEQ ID NO: 226), EVNKRPS (SEQ ID NO: 227), and SSLFGRWDVV (SEQ ID NO: 228).

The heavy chain CDRs of the 5147_N06 (PGT-130) antibody have the following sequences per Chothia definition: GESINTGH (SEQ ID NO: 220), HIHYTTAVL (SEQ ID NO: 221), and SGGDILYYYEWQKPHWFSP (SEQ ID NO: 219). The light chain CDRs of the 5147_N06 (PGT-130) antibody have the following sequences per Chothia definition: NGTSSDIGGWNFVS (SEQ ID NO: 226), EVNKRPS (SEQ ID NO: 227), and SSLFGRWDVV (SEQ ID NO: 228).

The 5343_B08 (PGT-135) antibody includes a heavy chain variable region (SEQ ID NO: 232), encoded by the nucleic acid sequence shown in SEQ ID NO: 230, and a light chain variable region (SEQ ID NO: 242) encoded by the nucleic acid sequence shown in SEQ ID NO: 239.

The heavy chain CDRs of the 5343_B08 (PGT-135) antibody have the following sequences per Kabat definition: GGEWGDKDYHWG (SEQ ID NO: 233), SIHWRGT-THYKESLRR (SEQ ID NO: 234), and HRHHDVFMLV-PIAGWFDV (SEQ ID NO: 235). The light chain CDRs of the 5343_B08 (PGT-135) antibody have the following sequences per Kabat definition: RASQNINKNLA (SEQ ID NO: 243), ETYSKIA (SEQ ID NO: 244), and QQYEE-WPRT (SEQ ID NO: 245).

The heavy chain CDRs of the 5343_B08 (PGT-135) antibody have the following sequences per Chothia definition: GDSIRGGEWGDKD (SEQ ID NO: 236), SIH-WRGTTH (SEQ ID NO: 237), and HRHHDVFMLVPIAG-WFDV (SEQ ID NO: 235). The light chain CDRs of the 5343_B08 (PGT-135) antibody have the following sequences per Chothia definition: RASQNINKNLA (SEQ ID NO: 243), ETYSKIA (SEQ ID NO: 244), and QQYEE-WPRT (SEQ ID NO: 245).

The 5344_E16 (PGT-135) antibody includes a heavy chain variable region (SEQ ID NO: 232), encoded by the nucleic acid sequence shown in SEQ ID NO: 230, and a light chain variable region (SEQ ID NO: 242) encoded by the nucleic acid sequence shown in SEQ ID NO: 239.

The heavy chain CDRs of the 5344_E16 (PGT-135) antibody have the following sequences per Kabat definition: GGEWGDKDYHWG (SEQ ID NO: 233), SIHWRGT-THYKESLRR (SEQ ID NO: 234), and HRHHDVFMLV-PIAGWFDV (SEQ ID NO: 235). The light chain CDRs of the 5344_E16 (PGT-135) antibody have the following sequences per Kabat definition: RASQNINKNLA (SEQ ID NO: 243), ETYSKIA (SEQ ID NO: 244), and QQYEE-WPRT (SEQ ID NO: 245).

The heavy chain CDRs of the 5344_E16 (PGT-135) antibody have the following sequences per Chothia definition: GDSIRGGEWGDKD (SEQ ID NO: 236), SIH-WRGTTH (SEQ ID NO: 237), and HRHHDVFMLVPIAG-WFDV (SEQ ID NO: 235). The light chain CDRs of the 5344_E16 (PGT-135) antibody have the following sequences per Chothia definition: RASQNINKNLA (SEQ ID NO: 243), ETYSKIA (SEQ ID NO: 244), and QQYEE-WPRT (SEQ ID NO: 245).

The 5329_C19 (PGT-136) antibody includes a heavy chain variable region (SEQ ID NO: 249), encoded by the nucleic acid sequence shown in SEQ ID NO: 247, and a light chain variable region (SEQ ID NO: 258) encoded by the nucleic acid sequence shown in SEQ ID NO: 256.

The heavy chain CDRs of the 5329_C19 (PGT-136) antibody have the following sequences per Kabat definition: GTDWGENDFHYG (SEQ ID NO: 250), SIHWRGRT-THYKTSFRS (SEQ ID NO: 251), and HKYHDIFRV-VPVAGWFDP (SEQ ID NO: 252). The light chain CDRs of the 5329_C19 (PGT-136) antibody have the following sequences per Kabat definition: RASQNVKNNLA (SEQ ID NO: 259), DASSRAG (SEQ ID NO: 260), and QQYEE-WPRT (SEQ ID NO: 245).

The heavy chain CDRs of the 5329_C19 (PGT-136) antibody have the following sequences per Chothia definition: GGSMRGTDWGEND (SEQ ID NO: 253), SIHW-RGRTTH (SEQ ID NO: 254), and HKYHDIFRVVPVAG-WFDP (SEQ ID NO: 252). The light chain CDRs of the 5329_C19 (PGT-136) antibody have the following sequences per Chothia definition: RASQNVKNNLA (SEQ ID NO: 259), DASSRAG (SEQ ID NO: 260), and QQY-EEWPRT (SEQ ID NO: 245).

The 5366_P21 (PGT-136) antibody includes a heavy chain variable region (SEQ ID NO: 249), encoded by the nucleic acid sequence shown in SEQ ID NO: 247, and a light chain variable region (SEQ ID NO: 258) encoded by the nucleic acid sequence shown in SEQ ID NO: 256.

The heavy chain CDRs of the 5366_P21 (PGT-136) antibody have the following sequences per Kabat definition: GTDWGENDFHYG (SEQ ID NO: 250), SIHWRGRT-THYKTSFRS (SEQ ID NO: 251), and HKYHDIFRV-VPVAGWFDP (SEQ ID NO: 252). The light chain CDRs of the 5366_P21 (PGT-136) antibody have the following sequences per Kabat definition: RASQNVKNNLA (SEQ ID NO: 259), DASSRAG (SEQ ID NO: 260), and QQYEE-WPRT (SEQ ID NO: 245).

The heavy chain CDRs of the 5366_P21 (PGT-136) antibody have the following sequences per Chothia definition: GGSMRGTDWGEND (SEQ ID NO: 253), SIHWR-GRTTH (SEQ ID NO: 254), and HKYHDIFRVVPVAG- WFDP (SEQ ID NO: 252). The light chain CDRs of the 5366_1³21 (PGT-136) antibody have the following sequences per Chothia definition: RASQNVKNNLA (SEQ ID NO: 259), DASSRAG (SEQ ID NO: 260), and QQYEEWPRT (SEQ ID NO: 245).

The 5964_G22 (PGT-141) antibody includes a heavy chain variable region (SEQ ID NO: 276), encoded by the nucleic acid sequence shown in SEQ ID NO: 274, and a light chain variable region (SEQ ID NO: 285) encoded by the nucleic acid sequence shown in SEQ ID NO: 283.

The heavy chain CDRs of the 5964_G22 (PGT-141) antibody have the following sequences per Kabat definition: KYDVH (SEQ ID NO: 277), WMSHEGDKTESAQRFKG (SEQ ID NO: 278), and GSKHRLRDYVLYDDYGLINYQEWNDYLEFLDV (SEQ ID NO: 279). The light chain CDRs of the 5964_G22 (PGT-141) antibody have the following sequences per Kabat definition: SSTQSLRHSNGANYLA (SEQ ID NO: 286), LGSQRAS (SEQ ID NO: 287), and MQGLNRPWT (SEQ ID NO: 288).

The heavy chain CDRs of the 5964_G22 (PGT-141) antibody have the following sequences per Chothia definition: GNTFSK (SEQ ID NO: 280), WMSHEGDKTE (SEQ ID NO: 281), and GSKHRLRDYVLYDDYGLINYQEWNDYLEFLDV (SEQ ID NO: 279). The light chain CDRs of the 5964_G22 (PGT-141) antibody have the following sequences per Chothia definition: SSTQSLRHSNGANYLA (SEQ ID NO: 286), LGSQRAS (SEQ ID NO: 287), and MQGLNRPWT (SEQ ID NO: 288).

The 4993_K13 (PGT-141) antibody includes a heavy chain variable region (SEQ ID NO: 276), encoded by the nucleic acid sequence shown in SEQ ID NO: 290, and a light chain variable region (SEQ ID NO: 285) encoded by the nucleic acid sequence shown in SEQ ID NO: 283.

The heavy chain CDRs of the 4993_K13 (PGT-141) antibody have the following sequences per Kabat definition: KYDVH (SEQ ID NO: 277), WMSHEGDKTESAQRFKG (SEQ ID NO: 278), and GSKHRLRDYVLYDDYGLINYQEWNDYLEFLDV (SEQ ID NO: 279). The light chain CDRs of the 4993_K13 (PGT-141) antibody have the following sequences per Kabat definition: SSTQSLRHSNGANYLA (SEQ ID NO: 286), LGSQRAS (SEQ ID NO: 287), and MQGLNRPWT (SEQ ID NO: 288).

The heavy chain CDRs of the 4993_K13 (PGT-141) antibody have the following sequences per Chothia definition: GNTFSK (SEQ ID NO: 280), WMSHEGDKTE (SEQ ID NO: 281), and GSKHRLRDYVLYDDYGLINYQEWNDYLEFLDV (SEQ ID NO: 279). The light chain CDRs of the 4993_K13 (PGT-141) antibody have the following sequences per Chothia definition: SSTQSLRHSNGANYLA (SEQ ID NO: 286), LGSQRAS (SEQ ID NO: 287), and MQGLNRPWT (SEQ ID NO: 288).

The 4995_E20 (PGT-142) antibody includes a heavy chain variable region (SEQ ID NO: 292), encoded by the nucleic acid sequence shown in SEQ ID NO: 315, and a light chain variable region (SEQ ID NO: 285) encoded by the nucleic acid sequence shown in SEQ ID NO: 283.

The heavy chain CDRs of the 4995_E20 (PGT-142) antibody have the following sequences per Kabat definition: KYDVH (SEQ ID NO: 277), WISHERDKTESAQRFKG (SEQ ID NO: 293), and GSKHRLRDYVLYDDYGLINYQEWNDYLEFLDV (SEQ ID NO: 279). The light chain CDRs of the 4995_E20 (PGT-142) antibody have the following sequences per Kabat definition: SSTQSLRHSNGANYLA (SEQ ID NO: 286), LGSQRAS (SEQ ID NO: 287), and MQGLNRPWT (SEQ ID NO: 288).

The heavy chain CDRs of the 4995_E20 (PGT-142) antibody have the following sequences per Chothia definition: GNTFSK (SEQ ID NO: 280), WISHERDKTE (SEQ ID NO: 294), and GSKHRLRDYVLYDDYGLINYQEWNDYLEFLDV (SEQ ID NO: 279). The light chain CDRs of the 4995_E20 (PGT-142) antibody have the following sequences per Chothia definition: SSTQSLRHSNGANYLA (SEQ ID NO: 286), LGSQRAS (SEQ ID NO: 287), and MQGLNRPWT (SEQ ID NO: 288).

The 4980_N08 (PGT-143) antibody includes a heavy chain variable region (SEQ ID NO: 298), encoded by the nucleic acid sequence shown in SEQ ID NO: 296, and a light chain variable region (SEQ ID NO: 302) encoded by the nucleic acid sequence shown in SEQ ID NO: 300.

The heavy chain CDRs of the 4980_N08 (PGT-143) antibody have the following sequences per Kabat definition: KYDVH (SEQ ID NO: 277), WMSHEGDKTESAQRFKG (SEQ ID NO: 278), and GSKHRLRDYVLYDDYGLINYQEWNDYLEFLDV (SEQ ID NO: 279). The light chain CDRs of the 4980_N08 (PGT-143) antibody have the following sequences per Kabat definition: TSTQSLRHSNGANYLA (SEQ ID NO: 303), LGSQRAS (SEQ ID NO: 287), and MQGLNRPWT (SEQ ID NO: 288).

The heavy chain CDRs of the 4980_N08 (PGT-143) antibody have the following sequences per Chothia definition: GNTFSK (SEQ ID NO: 280), WMSHEGDKTE (SEQ ID NO: 281), and GSKHRLRDYVLYDDYGLINYQEWNDYLEFLDV (SEQ ID NO: 279). The light chain CDRs of the 4980_N08 (PGT-143) antibody have the following sequences per Chothia definition: TSTQSLRHSNGANYLA (SEQ ID NO: 303), LGSQRAS (SEQ ID NO: 287), and MQGLNRPWT (SEQ ID NO: 288).

The 4970_K22 (PGT-144) antibody includes a heavy chain variable region (SEQ ID NO: 307), encoded by the nucleic acid sequence shown in SEQ ID NO: 305, and a light chain variable region (SEQ ID NO: 313) encoded by the nucleic acid sequence shown in SEQ ID NO: 311.

The heavy chain CDRs of the 4970_K22 (PGT-144) antibody have the following sequences per Kabat definition: KYDVH (SEQ ID NO: 277), WMSHEGDKTESAQRFKG (SEQ ID NO: 278), and GSKHRLRDYVLYDDYGLINQQEWNDYLEFLDV (SEQ ID NO: 308). The light chain CDRs of the 4970_K22 (PGT-144) antibody have the following sequences per Kabat definition: TSTQSLRHSNGANYLA (SEQ ID NO: 303), LGSQRAS (SEQ ID NO: 287), and MQGLNRPWT (SEQ ID NO: 288).

The heavy chain CDRs of the 4970_K22 (PGT-144) antibody have the following sequences per Chothia definition: GNTFRK (SEQ ID NO: 309), WMSHEGDKTE (SEQ ID NO: 281), and GSKHRLRDYVLYDDYGLINQQEWNDYLEFLDV (SEQ ID NO: 308). The light chain CDRs of the 4970_K22 (PGT-144) antibody have the following sequences per Chothia definition: TSTQSLRHSNGANYLA (SEQ ID NO: 303), LGSQRAS (SEQ ID NO: 287), and MQGLNRPWT (SEQ ID NO: 288).

The sequences of additional human monoclonal antibodies were determined, including the sequences of the variable regions of the Gamma heavy and Kappa or Lambda light chains. In addition, the sequence of each of the polynucleotides encoding the antibody sequences was determined. Shown below are the polypeptide and polynucleotide sequences of the gamma heavy chains and kappa light chains, with the signal peptides at the N-terminus (or 5' end) and the constant regions at the C-terminus (or 3' end) of the variable regions, which are shown in bolded text.

5145_B14 (PGT-127) gamma heavy chain nucleotide sequence: coding sequence (variable region in bold)

(SEQ ID NO: 316)
ATGAAACACCTGTGGTTCTTCCTCCTGCTGGTGGCGGCTCCCAGATGG
GTCCTGTCCCAGCCGCAGCTGCAGGAGTCGGGCCCAGGACTGGTG
GAGGCTTCGGAGACCCTGTCCCTCACGTGCACTGTGTCCGGCGAC
TCCACTGGTCGTTGTAATTATTTCTGGGGCTGGGTCCGGCAGCCC
CCAGGGAAGGGGCTGGAGTGGATTGGGAGTTTGTCCCACTGTAGA
AGTTACTACAATACTGACTGGACCTACCACAACCCGTCTCTCAAGA
GTCGACTCACTATTTCACTCGACACGCCCAAGAATCAGGTCTTCCT
GAGATTGACCTCTGTGACCGCCGCGGACACGGCCACTTATTACTG
TGCGCGATTCGGCGGCGAAGTTCTAGTGTACAGAGATTGGCCAAA
GCCGCCTGGGTCGACCTCTGGGGCCGGGGAACGCTGGTCGTCA
CCGTCTCGAGCGCCTCCACCAAGGGCCCATCGGTCTTCCCCCTGGCAC
CCTCCTCCAAGAGCACCTCTGGGGGCACAGCGGCCCTGGGCTGCCTGG
TCAAGGACTACTTCCCCGAACCGGTGACGGTGTCGTGGAACTCAGGCG
CCCTGACCAGCGGCGTGCACACCTTCCCGGCTGTCCTACAGTCCTCAG
GACTCTACTCCCTCAGCAGCGTGGTGACCGTGCCCTCCAGCAGCTTGG
GCACCCAGACCTACATCTGCAACGTGAATCACAAGCCCAGCAACACCA
AGGTGGACAAGAGAGTTGAGCCCAAATCTTGTGACAAAACTCACACAT
GCCCACCGTGCCCAGCACCTGAACTCCTGGGGGGACCGTCAGTCTTCC
TCTTCCCCCCAAAACCCAAGGACACCCTCATGATCTCCCGGACCCCTG
AGGTCACATGCGTGGTGGTGGACGTGAGCCACGAAGACCCTGAGGTC
AAGTTCAACTGGTACGTGGACGGCGTGGAGGTGCATAATGCCAAGAC
AAAGCCGCGGGAGGAGCAGTACAACAGCACGTACCGTGTGGTCAGCG
TCCTCACCGTCCTGCACCAGGACTGGCTGAATGGCAAGGAGTACAAGT
GCAAGGTCTCCAACAAAGCCCTCCCAGCCCCCATCGAGAAAACCATCT
CCAAAGCCAAAGGGCAGCCCCGAGAACCACAGGTGTACACCCTGCCC
CCATCCCGGAGGAGATGACCAAGAACCAGGTCAGCCTGACCTGCCT
GGTCAAAGGCTTCTATCCCAGCGACATCGCCGTGGAGTGGGAGAGCAA
TGGGCAGCCGGAGAACAACTACAAGACCACGCCTCCCGTGCTGGACTC
CGACGGCTCCTTCTTCCTCTATAGCAAGCTCACCGTGGACAAGAGCAG
GTGGCAGCAGGGGAACGTCTTCTCATGCTCCGTGATGCATGAGGCTCT
GCACAACCACTACACGCAGAAGAGCCTCTCCCTGTCTCCGGGTAAATG
A

5145_B14 (PGT-127) gamma heavy chain variable region nucleotide sequence:

(SEQ ID NO: 317)
CAGCCGCAGCTGCAGGAGTCGGGCCCAGGACTGGTGGAGGCTTCGGA
GACCCTGTCCCTCACGTGCACTGTGTCCGGCGACTCCACTGGTCGTTGT
AATTATTTCTGGGGCTGGGTCCGGCAGCCCCCAGGGAAGGGGCTGGAG
TGGATTGGGAGTTTGTCCCACTGTAGAAGTTACTACAATACTGACTGG
ACCTACCACAACCCGTCTCTCAAGAGTCGACTCACTATTTCACTCGAC
ACGCCCAAGAATCAGGTCTTCCTGAGATTGACCTCTGTGACCGCCGCG
GACACGGCCACTTATTACTGTGCGCGATTCGGCGGCGAAGTTCTAGTG
TACAGAGATTGGCCAAAGCCGCCTGGGTCGACCTCTGGGGCCGGGG
AACGCTGGTCGTCACCGTCTCGAGC

5145_B14 (PGT-127) gamma heavy chain amino acid sequence: expressed protein with leader sequence in italics and variable region in bold.

(SEQ ID NO: 318)
*MKHLWFFLLLLVAAPRWVLS*QPQLQESGPGLVEASETLSLTCTVSGDSTG
RCNYFWGWVRQPPGKGLEWIGSLSHCRSYYNTDWTYHNPSLKSRLT
ISLDTPKNQVFLRLTSVTAADTATYYCARFGGEVLVYRDWPKPAWVD
LWGRGTLVVTVSSASTKGPSVFPLAPSSKSTSGGTAALGCLVKDYFPEPV
TVSWNSGALTSGVHTFPAVLQSSGLYSLSSVVTVPSSSLGTQTYICNVNH
KPSNTKVDKRVEPKSCDKTHTCPPCPAPELLGGPSVFLFPPKPKDTLMIS
RTPEVTCVVVDVSHEDPEVKFNWYVDGVEVHNAKTKPREEQYNSTYRVVS
VLTVLHQDWLNGKEYKCKVSNKALPAPIEKTISKAKGQPREPQVYTLPPS
REEMTKNQVSLTCLVKGFYPSDIAVEWESNGQPENNYKTTPPVLDSDGSF
FLYSKLTVDKSRWQQGNVFSCSVMHEALHNHYTQKSLSLSPGK

5145_B14 (PGT-127) gamma heavy chain variable region amino acid sequence:
(Kabat CDRs underlined, Chothia CDRs in bold italics)

(SEQ ID NO: 319)
QPQLQESGPGLVEASETLSLTCTVS*GDSTGR*<u>CNYFWG</u>WVRQPPGKGL
EWIG<u>*SLSHCRSYYNTDWTY*HNPSLKS</u>RLTISLDTPKNQVFLRLTSVT
AADTATYYCAR*FGGEVLVRDWPKPAWVDL*WGRGTLVVTSS

5145_B14 (PGT-127) gamma heavy chain Kabat CDRs:

(SEQ ID NO: 320)
CDR 1: RCNYFWG (SEQ ID NO: 321)
CDR 2: SLSHCRSYYNTDWTYHNPSLKS (SEQ ID NO: 322)
CDR 3: FGGEVLVYRDWPKPAWVDL

5145_B14 (PGT-127) gamma heavy chain Chothia CDRs:

(SEQ ID NO: 323)
CDR 1: GDSTGRCN (SEQ ID NO: 324)
CDR 2: SLSHCRSYYNTDWTY (SEQ ID NO: 322)
CDR 3: FGGEVLVYRDWPKPAWVDL

5145_B14 (PGT-127) lambda light chain nucleotide sequence: coding sequence (variable region in bold)

(SEQ ID NO: 327)
ATGGCCTGGGCTCTGCTCCTCCTCACCCTCCTCACTCAGGGCACAGGG

```
GCCTGGGCCCAGTCTGCCCTGACTCAGCCTCCCTCCGCGTCCGGGT
CTCCTGGACAGTCAATCACCATCTCCTGCACTGGAACCAGCAATA
ACTTTGTCTCCTGGTACCAACAATACCCAGGCAAGGCCCCCAAAC
TCGTCATTTATGAGGTCAATAAGCGCCCCTCAGGTGTCCCTGATC
GTTTCTCTGGCTCCAAGTCTGGCAGCACGGCCTCCCTGACCGTCT
CTGGACTCCAGGCTGACGATGAGGGTGTCTATTATTGTAGTTCAC
TTGTAGGCAACTGGGATGTGATTTTCGGCGGAGGGACCAAGTTGA
CCGTCCTAGGTCAGCCCAAGGCTGCCCCCTCGGTCACTCTGTTCCCGC
CCTCCTCTGAGGAGCTTCAAGCCAACAAGGCCACACTGGTGTGTCTCA
TAAGTGACTTCTACCCGGGAGCCGTGACAGTGGCCTGGAAGGCAGATA
GCAGCCCCGTCAAGGCGGGAGTGGAGACCACCACACCCTCCAAACAA
AGCAACAACAAGTACGCGGCCAGCAGCTATCTGAGCCTGACGCCTGA
GCAGTGGAAGTCCCACAGAAGCTACAGCTGCCAGGTCACGCATGAAG
GGAGCACCGTGGAGAAGACAGTGGCCCCTACAGAATGTTCATAG
```

5145_B14 (PGT-127) lambda light chain variable region nucleotide sequence:

(SEQ ID NO: 328)
```
CAGTCTGCCCTGACTCAGCCTCCCTCCGCGTCCGGGTCTCCTGGACAGT
CAATCACCATCTCCTGCACTGGAACCAGCAATAACTTTGTCTCCTGGTA
CCAACAATACCCAGGCAAGGCCCCCAAACTCGTCATTTATGAGGTCAA
TAAGCGCCCCTCAGGTGTCCCTGATCGTTTCTCTGGCTCCAAGTCTGGC
AGCACGGCCTCCCTGACCGTCTCTGGACTCCAGGCTGACGATGAGGGT
GTCTATTATTGTAGTTCACTTGTAGGCAACTGGGATGTGATTTTCGGCG
GAGGGACCAAGTTGACCGTCCTA
```

5145_B14 (PGT-127) lambda light chain amino acid sequence: expressed protein with leader sequence in italics and variable region in bold.

(SEQ ID NO: 329)
*MAWALLLLTLLTQGTGAWA***QSALTQPPSASGSPGQSITISCTGTSNNFVS
WYQQYPGKAPKLVIYEVNKRPSGVPDRFSGSKSGSTASLTVSGLQAD
DEGVYYCSSLVGNWDVIFGGGTKLTVL**GQPKAAPSVTLFPPSSEELQAN
KATLVCLISDFYPGAVTVAWKADSSPVKAGVETTTPSKQSNNKYAASSYL
SLTPEQWKSHRSYSCQVTHEGSTVEKTVAPTECS

5145_B14 (PGT-127) lambda light chain variable region amino acid sequence: (Kabat CDRs underlined, Chothia CDRs in bold italics)

(SEQ ID NO: 330)
QSALTQPPSASGSPGQSITISC*TGTSNNFVS*WYQQYPGKAPKLVIY
*EVNKRPS*GVPDRFSGSKSGSTASLTVSGLQADDEGVYYC
*SSLVGNWDVI*FGGGTKLTVL

5145_B14 (PGT-127) lambda light chain Kabat CDRs:

(SEQ ID NO: 325)
CDR 1: TGTSNNFVS (SEQ ID NO: 227)
CDR 2: EVNKRPS (SEQ ID NO: 212)
CDR 3: SSLVGNWDVI

5145_B14 (PGT-127) lambda light chain Chothia CDRs:

(SEQ ID NO: 325)
CDR 1: TGTSNNFVS (SEQ ID NO: 227)
CDR 2: EVNKRPS (SEQ ID NO: 212)
CDR 3: SSLVGNWDVI

5114_A19 (PGT-128) gamma heavy chain nucleotide sequence: coding sequence (variable region in bold)

(SEQ ID NO: 331)
ATGAAACACCTGTGGTTCTTCCTCCTGCTGGTGGCGGCTCCCAGATGG
GTCCTGTCC**CAGCCGCAGCTGCAGGAGTCGGGCCCAACACTGGTG
GAGGCTTCGGAGACTCTGTCCCTCACCTGCGCTGTGTCCGGCGAC
TCCACTGCTGCATGTAATTCTTTCTGGGGCTGGGTCCGGCAGCCC
CCAGGGAAGGGGCTGGAGTGGGTTGGGAGTTTGTCCCATTGTGCA
AGCTATTGGAATCGTGGTGGACCTACCACAACCCGTCTCTCAAG
AGTCGGCTCACGCTTGCTCTCGACACACCCAAGAATCTGGTCTTC
CTCAAATTAAATTCTGTGACTGCCGCGGACACGGCCACTTACTACT
GTGCGCGATTCGGCGGCGAAGTTTTACGCTACACGGATTGGCCAA
AGCCGGCCTGGGTCGACCTCTGGGGCCGGGGAACGCTGGTCACC
GTCTCGAGC**GCCTCCACCAAGGGCCCATCGGTCTTCCCCCTGGCACCC
TCCTCCAAGAGCACCTCTGGGGGCACAGCGGCCCTGGGCTGCCTGGTC
AAGGACTACTTCCCCGAACCGGTGACGGTGTCGTGGAACTCAGGCGCC
CTGACCAGCGGCGTGCACACCTTCCCGGCTGTCCTACAGTCCTCAGGA
CTCTACTCCCTCAGCAGCGTGGTGACCGTGCCCTCCAGCAGCTTGGGC
ACCCAGACCTACATCTGCAACGTGAATCACAAGCCCAGCAACACCAA
GGTGGACAAGAGAGTTGAGCCCAAATCTTGTGACAAAACTCACACATG
CCCACCGTGCCCAGCACCTGAACTCCTGGGGGGACCGTCAGTCTTCCT
CTTCCCCCCAAAACCCAAGGACACCCTCATGATCTCCCGGACCCCTGA
GGTCACATGCGTGGTGGTGGACGTGAGCCACGAAGACCCTGAGGTCA
AGTTCAACTGGTACGTGGACGGCGTGGAGGTGCATAATGCCAAGACA
AAGCCGCGGGAGGAGCAGTACAACAGCACGTACCGTGTGGTCAGCGT
CCTCACCGTCCTGCACCAGGACTGGCTGAATGGCAAGGAGTACAAGTG
CAAGGTCTCCAACAAAGCCCTCCCAGCCCCCATCGAGAAAACCATCTC
CAAAGCCAAAGGGCAGCCCCGAGAACCACAGGTGTACACCCTGCCCC
CATCCCGGGAGGAGATGACCAAGAACCAGGTCAGCCTGACCTGCCTG
GTCAAAGGCTTCTATCCCAGCGACATCGCCGTGGAGTGGGAGAGCAAT
```

```
GGGCAGCCGGAGAACAACTACAAGACCACGCCTCCCGTGCTGGACTC

CGACGGCTCCTTCTTCCTCTATAGCAAGCTCACCGTGGACAAGAGCAG

GTGGCAGCAGGGGAACGTCTTCTCATGCTCCGTGATGCATGAGGCTCT

GCACAACCACTACACGCAGAAGAGCCTCTCCCTGTCTCCGGGTAAATG

A
```

5114_A19 (PGT-128) gamma heavy chain variable region nucleotide sequence:

```
                                            (SEQ ID NO: 332)
CAGCCGCAGCTGCAGGAGTCGGGCCCAACACTGGTGGAGGCTTCGGA

GACTCTGTCCCTCACCTGCGCTGTGTCCGGCGACTCCACTGCTGCATGT

AATTCTTTCTGGGGCTGGGTCCGGCAGCCCCCAGGGAAGGGGCTGGAG

TGGGTTGGGAGTTTGTCCCATTGTGCAAGCTATTGGAATCGTGGGTGG

ACCTACCACAACCCGTCTCTCAAGAGTCGGCTCACGCTTGCTCTCGAC

ACACCCAAGAATCTGGTCTTCCTCAAATTAAATTCTGTGACTGCCGCG

GACACGGCCACTTACTACTGTGCGCGATTCGGCGGCGAAGTTTTACGC

TACACGGATTGGCCAAAGCCGGCCTGGGTCGACCTCTGGGGCCGGGGA

ACGCTGGTCACCGTCTCGAGC
```

5114_A19 (PGT-128) gamma heavy chain amino acid sequence: expressed protein with leader sequence in italics and variable region in bold.

```
                                            (SEQ ID NO: 333)
MKHLWFFLLLVAAPRWVLSQPQLQESGPTLVEASETLSLTCAVSGDSTAA

CNSFWGWVRQPPGKGLEWVGSLSHCASYWNRGWTYHNPSLKSRLT

LALDTPKNLVFLKLNSVTAADTATYYCARFGGEVLRYTDWPKPAWV

DLWGRGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDKRVEPKSCDKTHTCPPCPAPELLGGPSVFLFPPKPKDTLMIS

RTPEVTCVVVDVSHEDPEVKFNWYVDGVEVHNAKTKPREEQYNSTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSGSF

FLYSKLTVDKSRWQQGNVFSCSVMHEALHNHYTQKSLSLSPGK
```

5114_A19 (PGT-128) gamma heavy chain variable region amino acid sequence: (Kabat CDRs underlined, Chothia CDRs in bold italics)

```
                                            (SEQ ID NO: 334)
QPQLQESGPTLVEASETLSLTCAVS*GDSTAACN*SFWGWVRQPPGKGLEW

VG*SLSHCASYWNRGWTY*HNPSLKSRLTLALDTPKNLVFLKLNSVTAADT

ATYYCAR*FGGEVLRYTDWPKPAWVDL*WGRGTLVTVSS
```

5114_A19 (PGT-128) gamma heavy chain Kabat CDRs:

```
CDR 1:
                                            (SEQ ID NO: 326)
ACNSFWG
```

```
CDR 2:
                                            (SEQ ID NO: 335)
SLSHCASYWNRGWTYHNPSLKS

CDR 3:
                                            (SEQ ID NO: 336)
FGGEVLRYTDWPKPAWVDL
```

5114_A19 (PGT-128) gamma heavy chain Chothia CDRs:

```
CDR 1:
                                            (SEQ ID NO: 337)
GDSTAACN

CDR 2:
                                            (SEQ ID NO: 338)
SLSHCASYWNRGWTY

CDR 3:
                                            (SEQ ID NO: 336)
FGGEVLRYTDWPKPAWVDL
```

5114_A19 (PGT-128) lambda light chain nucleotide sequence: coding sequence (variable region in bold)

```
                                            (SEQ ID NO: 390)
ATGGCCTGGGCTCTGCTCCTCCTCACCCTCCTCACTCAGGGCACAGGG

GCCTGGGCCCAGTCTGCCCTGACTCAGCCTCCCTCCGCGTCCGGGT

CTCCTGGACAGTCAATCACCATCTCCTGCACTGGAACCAGCAATA

ACTTTGTCTCCTGGTACCAGCAACACGCAGGCAAGGCCCCCAAGC

TCGTCATTTATGACGTCAATAAGCGCCCCTCAGGTGTCCCTGATCG

TTTCTCTGGCTCCAAGTCTGGCAACACGGCCTCCCTGACCGTCTCT

GGACTCCAGACTGACGATGAGGCTGTCTATTACTGCGGCTCACTT

GTAGGCAACTGGGATGTGATTTTCGGCGGAGGGACCAAGTTGACC

GTCCTAGGTCAGCCCAAGGCTGCCCCCTCGGTCACTCTGTTCCCGCCC

TCCTCTGAGGAGCTTCAAGCCAACAAGGCCACACTGGTGTGTCTCATA

AGTGACTTCTACCCGGGAGCCGTGACAGTGGCCTGGAAGGCAGATAGC

AGCCCCGTCAAGGCGGGAGTGGAGACCACCACACCCTCCAAACAAG

CAACAACAAGTACGCGGCCAGCAGCTATCTGAGCCTGACGCCTGAGC

AGTGGAAGTCCCACAGAAGCTACAGCTGCCAGGTCACGCATGAAGGG

AGCACCGTGGAGAAGACAGTGGCCCCTACAGAATGTTCATAG
```

5114_A19 (PGT-128) lambda light chain variable region nucleotide sequence:

```
                                            (SEQ ID NO: 391)
CAGTCTGCCCTGACTCAGCCTCCCTCCGCGTCCGGGTCTCCTGGACAGT

CAATCACCATCTCCTGCACTGGAACCAGCAATAACTTTGTCTCCTGGTA

CCAGCAACACGCAGGCAAGGCCCCCAAGCTCGTCATTTATGACGTCAA

TAAGCGCCCCTCAGGTGTCCCTGATCGTTTCTCTGGCTCCAAGTCTGGC

AACACGGCCTCCCTGACCGTCTCTGGACTCCAGACTGACGATGAGGCT

GTCTATTACTGCGGCTCACTTGTAGGCAACTGGGATGTGATTTTCGGCG

GAGGGACCAAGTTGACCGTCCTA
```

5114_A19 (PGT-128) lambda light chain amino acid sequence: expressed protein with leader sequence in italics and variable region in bold.

(SEQ ID NO: 392)
*MAWALLLLTLLTQGTGAWA*QSALTQPPSASGSPGQSITISCTGTSNNFVS
WYQQHAGKAPKLVIYDVNKRPSGVPDRFSGSKSGNTASLTVSGLQTD
DEAVYYCGSLVGNWDVIFGGGTKLTVLGQPKAAPSVTLFPPSSEELQA
NKATLVCLISDFYPGAVTVAWKADSSPVKAGVETTTPSKQSNNKYAASS
YLSLTPEQWKSHRSYSCQVTHEGSTVEKTVAPTECS

5114_A19 (PGT-128) lambda light chain variable region amino acid sequence: (Kabat CDRs underlined, Chothia CDRs in bold italics)

(SEQ ID NO: 393)
QSALTQPPSASGSPGQSITISC*TGTSNNFVS*WYQQHAGKAPKLVIY
*DVNKRPS*GVPDRFSGSKSGNTASLTVSGLQTDDEAVYYC
*GSLVGNWDVI*FGGGTKLTVL

5114_A19 (PGT-128) lambda light chain Kabat CDRs:

CDR 1:
(SEQ ID NO: 325)
TGTSNNFVS

CDR 2:
(SEQ ID NO: 343)
DVNKRPS

CDR 3:
(SEQ ID NO: 196)
GSLVGNWDVI

5114_A19 (PGT-128) lambda light chain Chothia CDRs:

CDR 1:
(SEQ ID NO: 325)
TGTSNNFVS

CDR 2:
(SEQ ID NO: 343)
DVNKRPS

CDR 3:
(SEQ ID NO: 196)
GSLVGNWDVI

5136_H01 (PGT-131) gamma heavy chain nucleotide sequence: coding sequence (variable region in bold)

(SEQ ID NO: 344)
ATGAAACACCTGTGGTTCTTCCTCCTGCTGGTGGCGGCTCCCAGATGG
GTCCTTTCCCAGGTGCAACTACAGGAGTCGGGCCCAGGACTGGTGA
AGCCTTCGGAGACCCTTTCCCTCACCTGCACTGTCTCTGGTGACTC
CATCAACACTGGTCATCACTACTGGGGCTGGGTCCGTCAGGTCCC
AGGGAAGGGACCGGAATGGATTGCTCACATCCACTATAATACGGC
TGTCTTACACAATCCGGCCCTCAAGAGTCGAGTCACCATTTCGATT
TTCACCCTGAAGAATCTGATTACCCTGAGCCTCAGTAATGTGACCG
CCGCGGACACGGCCGTCTATTTCTGCGTTCGATCCGGCGGCGACA
TTTTATACTATATTGAGTGGCAAAAACCCCACTGGTTCTATCCCTG
GGGCCCGGGAATTTTGGTCACCGTCTCGAGCGCCTCCACCAAGGGC
CCATCGGTCTTCCCCCTGGCACCCTCCTCCAAGAGCACCTCTGGGGGC
ACAGCGGCCCTGGGCTGCCTGGTCAAGGACTACTTCCCCGAACCGGTG
ACGGTGTCGTGGAACTCAGGCGCCCTGACCAGCGGCGTGCACACCTTC
CCGGCTGTCCTACAGTCCTCAGGACTCTACTCCCTCAGCAGCGTGGTG
ACCGTGCCCTCCAGCAGCTTGGGCACCCAGACCTACATCTGCAACGTG
AATCACAAGCCCAGCAACACCAAGGTGGACAAGAGAGTTGAGCCCAA
ATCTTGTGACAAAACTCACACATGCCCACCGTGCCCAGCACCTGAACT
CCTGGGGGGACCGTCAGTCTTCCTCTTCCCCCCAAAACCCAAGGACAC
CCTCATGATCTCCCGGACCCCTGAGGTCACATGCGTGGTGGTGGACGT
GAGCCACGAAGACCCTGAGGTCAAGTTCAACTGGTACGTGGACGGCGT
GGAGGTGCATAATGCCAAGACAAAGCCGCGGGAGGAGCAGTACAACA
GCACGTACCGTGTGGTCAGCGTCCTCACCGTCCTGCACCAGGACTGGC
TGAATGGCAAGGAGTACAAGTGCAAGGTCTCCAACAAAGCCCTCCCA
GCCCCCATCGAGAAAACCATCTCCAAAGCCAAAGGGCAGCCCCGAGA
ACCACAGGTGTACACCCTGCCCCCATCCCGGGAGGAGATGACCAAGA
ACCAGGTCAGCCTGACCTGCCTGGTCAAAGGCTTCTATCCCAGCGACA
TCGCCGTGGAGTGGGAGAGCAATGGGCAGCCGGAGAACAACTACAAG
ACCACGCCTCCCGTGCTGGACTCCGACGGCTCCTTCTTCCTCTATAGCA
AGCTCACCGTGGACAAGAGCAGGTGGCAGCAGGGGAACGTCTTCTCAT
GCTCCGTGATGCATGAGGCTCTGCACAACCACTACACGCAGAAGAGCC
TCTCCCTGTCTCCGGGTAAATGA

5136_H01 (PGT-131) gamma heavy chain variable region nucleotide sequence:

(SEQ ID NO: 345)
CAGGTGCAACTACAGGAGTCGGGCCCAGGACTGGTGAAGCCTTCGGA
GACCCTTTCCCTCACCTGCACTGTCTCTGGTGACTCCATCAACACTGGT
CATCACTACTGGGGCTGGGTCCGTCAGGTCCCAGGGAAGGGACCGGA
ATGGATTGCTCACATCCACTATAATACGGCTGTCTTACACAATCCGGCC
CTCAAGAGTCGAGTCACCATTTCGATTTTCACCCTGAAGAATCTGATTA
CCCTGAGCCTCAGTAATGTGACCGCCGCGGACACGGCCGTCTATTTCT
GCGTTCGATCCGGCGGCGACATTTTATACTATATTGAGTGGCAAAAAC
CCCACTGGTTCTATCCCTGGGGCCCGGGAATTTTGGTCACCGTCTCGAG
C

5136_H01 (PGT-131) gamma heavy chain amino acid sequence: expressed protein with leader sequence in italics and variable region in bold.

(SEQ ID NO: 346)
*MKHLWFFLLLLVAAPRWVLS*QVQLQESGPGLVKPSETLSLTCTVSGDSINT
GHHYWGWVRQVPGKGPEWIAHIHYNTAVLHNPALKSRVTISIFTLKN

LITLSLSNVTAADTAVYFCVRSGGDILYYIEWQKPHWFYPWGPGILVT

VSSASTKGPSVFPLAPSSKSTSGGTAALGCLVKDYFPEPVTVSWNSGALT

SGVHTFPAVLQSSGLYSLSSVVTVPSSSLGTQTYICNVNHKPSNTKVDKR

VEPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDWL

NGKEYKCKVSNKALPAPIEKTISKAKGQPREPQVYTLPPSREEMTKNQVS

LTCLVKGFYPSDIAVEWESNGQPENNYKTTPPVLDSDGSFFLYSKLTVDK

SRWQQGNVFSCSVMHEALHNHYTQKSLSLSPGK

5136_H01 (PGT-131) gamma heavy chain variable region amino acid sequence: (Kabat CDRs underlined, Chothia CDRs in bold italics)

(SEQ ID NO: 347)
QVQLQESGPGLVKPSETLSLTCTVS*GDSINTGH*HYWGWVRQVPG

KGPEWIA*HIHYNTAVL*HNPALKSRVTISIFTLKNLITLSLSNVTAADTA

VYFCVR*SGGDILYYIEWQKPHWFYP*WGPGILVTVSS

5136_H01 (PGT-131) gamma heavy chain Kabat CDRs:

```
CDR 1:
                                   (SEQ ID NO: 348)
TGHHYWG

CDR 2:
                                   (SEQ ID NO: 349)
HIHYNTAVLHNPALKS

CDR 3:
                                   (SEQ ID NO: 350)
SGGDILYYIEWQKPHWFYP
```

5136_H01 (PGT-131) gamma heavy chain Chothia CDRs:

```
CDR 1:
                                   (SEQ ID NO: 351)
GDSINTGH

CDR 2:
                                   (SEQ ID NO: 352)
HIHYNTAVL

CDR 3:
                                   (SEQ ID NO: 350)
SGGDILYYIEWQKPHWFYP
```

5136_H01 (PGT-131) lambda light chain nucleotide sequence: coding sequence (variable region in bold)

(SEQ ID NO: 353)
ATGGCCTGGGCTCTGCTCCTCCTCACCCTCCTCACTCAGGGCACAGGGT

CCTGGGCCCAGTCTGCCCTGACTCAGCCTCCCTCCGCGTCCGGGTC

TCTTGGACAGTCACTCACCATCTCCTGCAGTGGAACCGGCAGTGA

CATTGGCAGTTGGAATTTTGTCTCCTGGTATCAACAATTCCCAGGC

AGAGCCCCCAACCTCATTATTTTTGAGGTCAATAGGCGGCGATCA

GGGGTCCCTGATCGCTTCTCTGGTTCCAAGTCGGGCAATACGGCC

TCCCTGACCGTCTCTGGGCTCCGGTCTGAGGATGAGGCTGAATAT

TTTTGCAGTTCCCTTTCAGGCAGGTGGGACATTGTTTTTGGCGGA

GGGACCAAGGTGACCGTCCTAGGTCAGCCCAAGGCTGCCCCCTCGG

TCACTCTGTTCCCGCCCTCCTCTGAGGAGCTTCAAGCCAACAAGGCCA

CACTGGTGTGTCTCATAAGTGACTTCTACCCGGGAGCCGTGACAGTGG

CCTGGAAGGCAGATAGCAGCCCCGTCAAGGCGGGAGTGGAGACCACC

ACACCCTCCAAACAAAGCAACAACAAGTACGCGGCCAGCAGCTATCT

GAGCCTGACGCCTGAGCAGTGGAAGTCCCACAGAAGCTACAGCTGCC

AGGTCACGCATGAAGGGAGCACCGTGGAGAAGACAGTGGCCCCCTACA

GAATGTTCATAG

5136_H01 (PGT-131) lambda light chain variable region nucleotide sequence:

(SEQ ID NO: 354)
CAGTCTGCCCTGACTCAGCCTCCCTCCGCGTCCGGGTCTCTTGGACAGT

CACTCACCATCTCCTGCAGTGGAACCGGCAGTGACATTGGCAGTTGGA

ATTTTGTCTCCTGGTATCAACAATTCCCAGGCAGAGCCCCCAACCTCAT

TATTTTTGAGGTCAATAGGCGGCGATCAGGGGTCCCTGATCGCTTCTCT

GGTTCCAAGTCGGGCAATACGGCCTCCCTGACCGTCTCTGGGCTCCGG

TCTGAGGATGAGGCTGAATATTTTTGCAGTTCCCTTTCAGGCAGGTGG

GACATTGTTTTTGGCGGAGGGACCAAGGTGACCGTCCTA

5136_H01 (PGT-131) lambda light chain amino acid sequence: expressed protein with leader sequence in italics and variable region in bold.

(SEQ ID NO: 355)
*MAWALLLLTLLTQGTGSWA*QSALTQPPSASGSLGQSLTISCSGTGSDIGS

WNFVSWYQQFPGRAPNLIIFEVNRRRSGVPDRFSGSKSGNTASLTVSG

LRSEDEAEYFCSSLSGRWDIVFGGGTKVTVLGQPKAAPSVTLFPPSSEE

LQANKATLVCLISDFYPGAVTVAWKADSSPVKAGVETTTPSKQSNNKYA

ASSYLSLTPEQWKSHRSYSCQVTHEGSTVEKTVAPTECS

5136_H01 (PGT-131) lambda light chain variable region amino acid sequence: (Kabat CDRs underlined, Chothia CDRs in bold italics)

(SEQ ID NO: 356)
QSALTQPPSASGSLGQSLTISC*SGTGSDIGSWNFVS*WYQQFPGRAPNLI

IF*EVNRRRS*PDRFSGSKSGNTASLTVSGLRSEDEAEYFC

*SSLSGRWDIV*FGGGTKVTVL

5136_H01 (PGT-131) lambda light chain Kabat CDRs:

```
CDR 1:
                                   (SEQ ID NO: 357)
SGTGSDIGSWNFVS

CDR 2:
                                   (SEQ ID NO: 358)
EVNRRRS
```

-continued

CDR 3:
SSLSGRWDIV (SEQ ID NO: 359)

5136_H01 (PGT-131) lambda light chain Chothia CDRs:

CDR 1:
SGTGSDIGSWNFVS (SEQ ID NO: 357)

CDR 2:
EVNRRRS (SEQ ID NO: 358)

CDR 3:
SSLSGRWDIV (SEQ ID NO: 359)

5345_I01 (PGT-137) gamma heavy chain nucleotide sequence: coding sequence (variable region in bold)

(SEQ ID NO: 360)
ATGAAACACCTGTGGTTCTTCCTCCTGCTGGTTGCGGCTCCCAGATGTG

TCCTGTCTGAGGTGCATCTGGAGGAGTCGGGCCCAGGACTGGTGA

GGCCCTCGGAGACCTTGTCCCTGACTTGCACGGCCTCTGGTGGCT

CCATAAGGGGGGCGAGTGGGGCGATAGTGACTACCACTGGGGC

TGGGTCCGCCACTCTCCCGAAAAGGGACTGGAATGGATTGGAAGT

ATTCATTGGCGGGGACCACCCACTACAACGCGCCCTTCCGGGGG

CGAGGCAGATTGTCGATAGACCTCTCCCGGAATCAATTCTCCCTG

CGCCTGACGTCTGTGACCGCCGAAGACACTGCCGTCTATTATTGT

GTGAAGCACAAATATCATGACATTGTCATGGTGGTCCCCATTGCG

GGCTGGTTCGACCCCTGGGGCCAGGGACTCCAGGTCACCGTCTCG

AGCGCCTCCACCAAGGGCCCATCGGTCTTCCCCCTGGCACCCTCCTCC

AAGAGCACCTCTGGGGGCACAGCGGCCCTGGGCTGCCTGGTCAAGGA

CTACTTCCCCGAACCGGTGACGGTGTCGTGGAACTCAGGCGCCCTGAC

CAGCGGCGTGCACACCTTCCCGGCTGTCCTACAGTCCTCAGGACTCTA

CTCCCTCAGCAGCGTGGTGACCGTGCCCTCCAGCAGCTTGGGCACCCA

GACCTACATCTGCAACGTGAATCACAAGCCCAGCAACACCAAGGTGG

ACAAGAGAGTTGAGCCCAAATCTTGTGACAAAACTCACACATGCCCAC

CGTGCCCAGCACCTGAACTCCTGGGGGGACCGTCAGTCTTCCTCTTCCC

CCCAAAACCCAAGGACACCCTCATGATCTCCCGGACCCCTGAGGTCAC

ATGCGTGGTGGTGGACGTGAGCCACGAAGACCCTGAGGTCAAGTTCAA

CTGGTACGTGGACGGCGTGGAGGTGCATAATGCCAAGACAAAGCCGC

GGGAGGAGCAGTACAACAGCACGTACCGTGTGGTCAGCGTCCTCACCG

TCCTGCACCAGGACTGGCTGAATGGCAAGGAGTACAAGTGCAAGGTCT

CCAACAAAGCCCTCCCAGCCCCCATCGAGAAAACCATCTCCAAAGCCA

AAGGGCAGCCCCGAGAACCACAGGTGTACACCCTGCCCCCATCCCGG

GAGGAGATGACCAAGAACCAGGTCAGCCTGACCTGCCTGGTCAAAGG

CTTCTATCCCAGCGACATCGCCGTGGAGTGGGAGAGCAATGGGCAGCC

GGAGAACAACTACAAGACCACGCCTCCCGTGCTGGACTCCGACGGCTC

CTTCTTCCTCTATAGCAAGCTCACCGTGGACAAGAGCAGGTGGCAGCA

GGGGAACGTCTTCTCATGCTCCGTGATGCATGAGGCTCTGCACAACCA

CTACACGCAGAAGAGCCTCTCCCTGTCTCCGGGTAAATGA

5345_I01 (PGT-137) gamma heavy chain variable region nucleotide sequence:

(SEQ ID NO: 361)
GAGGTGCATCTGGAGGAGTCGGGCCCAGGACTGGTGAGGCCCTCGGA

GACCTTGTCCCTGACTTGCACGGCCTCTGGTGGCTCCATAAGGGGGGG

CGAGTGGGGCGATAGTGACTACCACTGGGGCTGGGTCCGCCACTCTCC

CGAAAAGGGACTGGAATGGATTGGAAGTATTCATTGGCGGGGACCA

CCCACTACAACGCGCCCTTCCGGGGGCGAGGCAGATTGTCGATAGACC

TCTCCCGGAATCAATTCTCCCTGCGCCTGACGTCTGTGACCGCCGAAG

ACACTGCCGTCTATTATTGTGTGAAGCACAAATATCATGACATTGTCAT

GGTGGTCCCCATTGCGGGCTGGTTCGACCCCTGGGGCCAGGGACTCCA

GGTCACCGTCTCGAGC

5345_I01 (PGT-137) gamma heavy chain amino acid sequence: expressed protein with leader sequence in italics and variable region in bold.

(SEQ ID NO: 362)
*MKHLWFFLLLLVAAPRCVLS*EVHLEESGPGLVRPSETLSLTCTASGGSIRG

GEWGDSDYHWGWVRHSPEKGLEWIGSIHWRGTTHYNAPFRGRGRL

SIDLSRNQFSLRLTSVTAEDTAVYYCVKHKYHDIVMVVPIAGWFDPW

GQGLQVTVSSASTKGPSVFPLAPSSKSTSGGTAALGCLVKDYFPEPVTVS

WNSGALTSGVHTFPAVLQSSGLYSLSSVVTVPSSSLGTQTYICNVNHKPSN

TKVDKRVEPKSCDKTHTCPPCPAPELLGGPSVFLFPPKPKDTLMISRTPEV

TCVVVDVSHEDPEVKFNWYVDGVEVHNAKTKPREEQYNSTYRVVSVLT

VLHQDWLNGKEYKCKVSNKALPAPIEKTISKAKGQPREPQVYTLPPSREE

MTKNQVSLTCLVKGFYPSDIAVEWESNGQPENNYKTTPPVLDSDGSFFLY

SKLTVDKSRWQQGNVFSCSVMHEALHNHYTQKSLSLSPGK

5345_I01 (PGT-137) gamma heavy chain variable region amino acid sequence: (Kabat CDRs underlined, Chothia CDRs in bold italics)

(SEQ ID NO: 363)
EVHLEESGPGLVRPSETLSLTCTAS*GGSIR**GGEWGDSD*YHWGWVRHSP

EKGLEWIG*SIHWRGTTH*YNAPFRGRGRLSIDLSRNQFSLRLTSVTAE

DTAVYYCVK*HKYHDIVMVVPIAGWFDP*WGQGLQVTVSS

5345_I01 (PGT-137) gamma heavy chain Kabat CDRs:

CDR 1:
GGEWGDSDYHWG (SEQ ID NO: 364)

CDR 2:
SIHWRGTTHYNAPFRG (SEQ ID NO: 365)

CDR 3:
(SEQ ID NO: 366)
HKYHDIVMVVPIAGWFDP

5345_I01 (PGT-137) gamma heavy chain Chothia CDRs:

CDR 1:
(SEQ ID NO: 367)
GGSIRGGEWGDSD

CDR 2:
(SEQ ID NO: 237)
SIHWRGTTH

CDR 3:
(SEQ ID NO: 366)
HKYHDIVMVVPIAGWFDP

5345_I01 (PGT-137) kappa light chain nucleotide sequence: coding sequence (variable region in bold)

(SEQ ID NO: 394)
ATGGAAACCCCAGCTCAGCTTCTCTTCCTCCTGCTACTCTGGCTCCCAG
ATACTACTGGAGAAATAATGATGACGCAGTCTCCAGCCATCCTGTC
TGTGTCTCCAGGAGACAGAGCCACACTCTCCTGCAGGGCCAGTCA
GAGTGTGAAGAATAATTTAGCCTGGTACCAGAAGAGACCTGGCCA
GGCTCCCAGACTCCTCATCTTTGATACATCCAGCAGGGCCTCTGG
TATCCCTGCCAGGTTCAGTGGCGGTGGTTCTGGGACAGAGTTCAC
TCTCACCGTCAACAGCATGCAGTCTGAAGACTTTGCGACTTATTAC
TGTCAGCAATATGAAGAGTGGCCTCGGACGTTCGGCCAGGGGACC
AAGGTGGAAATCAAACGTACGGTGGCTGCACCATCTGTCTTCATCTTC
CCGCCATCTGATGAGCAGTTGAAATCTGGAACTGCCTCTGTTGTGTGCC
TGCTGAATAACTTCTATCCCAGAGAGGCCAAAGTACAGTGGAAGGTGG
ATAACGCCCTCCAATCGGGTAACTCCCAGGAGAGTGTCACAGAGCAGG
ACAGCAAGGACAGCACCTACAGCCTCAGCAGCACCCTGACGCTGAGC
AAAGCAGACTACGAGAAACACAAAGTCTACGCCTGCGAAGTCACCCA
TCAGGGCCTGAGCTCGCCCGTCACAAAGAGCTTCAACAGGGGAGAGT
GTTAG

5345_I01 (PGT-137) kappa light chain variable region nucleotide sequence:

(SEQ ID NO: 395)
GAAATAATGATGACGCAGTCTCCAGCCATCCTGTCTGTGTCTCCAGGA
GACAGAGCCACACTCTCCTGCAGGGCCAGTCAGAGTGTGAAGAATAAT
TTAGCCTGGTACCAGAAGAGACCTGGCCAGGCTCCCAGACTCCTCATC
TTTGATACATCCAGCAGGGCCTCTGGTATCCCTGCCAGGTTCAGTGGC
GGTGGTTCTGGGACAGAGTTCACTCTCACCGTCAACAGCATGCAGTCT
GAAGACTTTGCGACTTATTACTGTCAGCAATATGAAGAGTGGCCTCGG
ACGTTCGGCCAGGGGACCAAGGTGGAAATCAAA

5345_I01 (PGT-137) kappa light chain amino acid sequence: expressed protein with leader sequence in italics and variable region in bold.

(SEQ ID NO: 396)
*METPAQLLELLLLWLPDTTG*EIMMTQSPAILSVSPGDRATLSCRASQSVK
NNLAWYQKRPGQAPRLLIFDTSSRASGIPARFSGGGSGTEFTLTVNSM
QSEDFATYYCQQYEEWPRTFGQGTKVEIKRTVAAPSVFIFPPSDEQLKS
GTASVVCLLNNFYPREAKVQWKVDNALQSGNSQESVTEQDSKDSTYSLS
STLTLSKADYEKHKVYACEVTHQGLSSPVTKSFNRGEC

5345_I01 (PGT-137) kappa light chain variable region amino acid sequence: (Kabat CDRs underlined, Chothia CDRs in bold italics)

(SEQ ID NO: 397)
EIMMTQSPAILSVSPGDRATLSC*RASQSVKNNLA*WYQKRPGQAPRLL
IF*DTSSRAS*GIPARFSGGGSGTEFTLTVNSMQSEDFATYYC
*QQYEEWPRT*FGQGTKVEIK

5345_I01 (PGT-137) kappa light chain Kabat CDRs:

(SEQ ID NO: 372)
CDR 1: RASQSVKNNLA (SEQ ID NO: 373)
CDR 2: DTSSRAS (SEQ ID NO: 245)
CDR 3: QQYEEWPRT

5345_I01 (PGT-137) kappa light chain Chothia CDRs:

(SEQ ID NO: 372)
CDR 1: RASQSVKNNLA (SEQ ID NO: 373)
CDR 2: DTSSRAS (SEQ ID NO: 245)
CDR 3: QQYEEWPRT

4995_P16 (PGT-145) gamma heavy chain nucleotide sequence: coding sequence (variable region in bold)

(SEQ ID NO: 398)
ATGGACTGGATTTGGAGGATCCTCTTCTTGGTGGCAGCAGCTACAAGT
GCCCACTCCCAGGTGCAGTTGGTGCAGTCTGGGGCTGAAGTGAAG
AAGCCTGGGTCCTCAGTGAAGGTCTCCTGCAAGGCCTCTGGAAAC
AGTTTCAGTAATCATGATGTCCACTGGGTACGACAGGCCACTGGA
CAGGGGCTTGAATGGATGGGATGGATGAGTCATGAGGGTGATAAG
ACAGGCTTGGCACAAAAGTTTCAGGGCAGAGTCACCATCACGAGG
GACAGTGGCGCAAGTACAGTCTACATGGAGTTGCGCGGCCTGACA
GCTGACGACACGGCCATTTATTATTGTTTGACCGGCTCAAAACATC
GCCTGCGAGATTATTTTCTGTACAATGAATATGGCCCCAATTATGA
AGAGTGGGGTGACTACCTTGCGACTTTGGACGTCTGGGGCCATGG
GACCGCGGTCACCGTCTCGAGCGCCTCCACCAAGGGCCCATCGGTC
TTCCCCCTGGCACCCTCCTCCAAGAGCACCTCTGGGGGCACAGCGGCC
CTGGGCTGCCTGGTCAAGGACTACTTCCCCGAACCGGTGACGGTGTCG

-continued
```
TGGAACTCAGGCGCCCTGACCAGCGGCGTGCACACCTTCCCGGCTGTC

CTACAGTCCTCAGGACTCTACTCCCTCAGCAGCGTGGTGACCGTGCCC

TCCAGCAGCTTGGGCACCCAGACCTACATCTGCAACGTGAATCACAAG

CCCAGCAACACCAAGGTGGACAAGAGAGTTGAGCCCAAATCTTGTGA

CAAAACTCACACATGCCCACCGTGCCCAGCACCTGAACTCCTGGGGGG

ACCGTCAGTCTTCCTCTTCCCCCCAAAACCCAAGGACACCCTCATGATC

TCCCGGACCCCTGAGGTCACATGCGTGGTGGTGGACGTGAGCCACGAA

GACCCTGAGGTCAAGTTCAACTGGTACGTGGACGGCGTGGAGGTGCAT

AATGCCAAGACAAAGCCGCGGGAGGAGCAGTACAACAGCACGTACCG

TGTGGTCAGCGTCCTCACCGTCCTGCACCAGGACTGGCTGAATGGCAA

GGAGTACAAGTGCAAGGTCTCCAACAAAGCCCTCCCAGCCCCCATCGA

GAAAACCATCTCCAAAGCCAAAGGGCAGCCCCGAGAACCACAGGTGT

ACACCCTGCCCCCATCCCGGGAGGAGATGACCAAGAACCAGGTCAGC

CTGACCTGCCTGGTCAAAGGCTTCTATCCCAGCGACATCGCCGTGGAG

TGGGAGAGCAATGGGCAGCCGGAGAACAACTACAAGACCACGCCTCC

CGTGCTGGACTCCGACGGCTCCTTCTTCCTCTATAGCAAGCTCACCGTG

GACAAGAGCAGGTGGCAGCAGGGGAACGTCTTCTCATGCTCCGTGATG

CATGAGGCTCTGCACAACCACTACACGCAGAAGAGCCTCTCCCTGTCT

CCGGGTAAATGA
```

4995_P16 (PGT-145) gamma heavy chain variable region nucleotide sequence:

(SEQ ID NO: 399)
```
CAGGTGCAGTTGGTGCAGTCTGGGGCTGAAGTGAAGAAGCCTGGGTCC

TCAGTGAAGGTCTCCTGCAAGGCCTCTGGAAACAGTTTCAGTAATCAT

GATGTCCACTGGGTACGACAGGCCACTGGACAGGGGCTTGAATGGATG

GGATGGATGAGTCATGAGGGTGATAAGACAGGCTTGGCACAAAAGTT

TCAGGGCAGAGTCACCATCACGAGGGACAGTGGCGCAAGTACAGTCT

ACATGGAGTTGCGCGGCCTGACAGCTGACGACACGGCCATTTATTATT

GTTTGACCGGCTCAAAACATCGCCTGCGAGATTATTTTCTGTACAATGA

ATATGGCCCCAATTATGAAGAGTGGGGTGACTACCTTGCGACTTTGGA

CGTCTGGGGCCATGGGACCGCGGTCACCGTCTCGAGC
```

4995_P16 (PGT-145) gamma heavy chain amino acid sequence: expressed protein with leader sequence in italics and variable region in bold.

(SEQ ID NO: 400)
*MDWIWRILFLVAAATSAHS*QVQLVQSGAEVKKPGSSVKVSCKASGNSFSN
HDVHWVRQATGQGLEWMGWMSHEGDKTGLAQKFQGRVTITRDSG
ASTVYMELRGLTADDTAIYYCLTGSKHRLRDYFLYNEYGPNYEEWG
DYLATLDVWGHGTAVTVSSASTKGPSVFPLAPSSKSTSGGTAALGCLVK
DYFPEPVTVSWNSGALTSGVHTFPAVLQSSGLYSLSSVVTVPSSSLGTQT
YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQ
VYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK

4995_P16 (PGT-145) gamma heavy chain variable region amino acid sequence: (Kabat CDRs underlined. Chothia CDRs in bold italics)

(SEQ ID NO: 401)
QVQLVQSGAEVKKPGSSVKVSCKAS*GNSFSN*<u>HDVH</u>WVRQATGQGLEW
MG*WMSHEGDKTG*<u>LAQKFQG</u>RVTITRDSGASTVYMELRGLTADDTAIY
YCLT<u>*GSKHRLRDYFLYNEYGPNYEEWGDYLATLDV*</u>WGHGTAVTVSS

4995_P16 (PGT-145) gamma heavy chain Kabat CDRs:

(SEQ ID NO: 378)
CDR 1: NHDVH (SEQ ID NO: 379)
CDR 2: WMSHEGDKTGLAQKFQG (SEQ ID NO: 380)
CDR 3: GSKHRLRDYFLYNEYGPNYEEWGDYLATLDV

4995_P16 (PGT-145) gamma heavy chain Chothia CDRs:

(SEQ ID NO: 381)
CDR 1: GNSFSN (SEQ ID NO: 382)
CDR 2: WMSHEGDKTG (SEQ ID NO: 380)
CDR 3: GSKHRLRDYFLYNEYGPNYEEWGDYLATLDV

4995_P16 (PGT-145) kappa light chain nucleotide sequence: coding sequence (variable region in bold)

(SEQ ID NO: 383)
ATGAGGCTCCCTGCTCAGCTCCTGGGGCTGCTAATGCTCTGGGTCTCTG
GATCCGGTGCGGAGGTTGTCATAACTCAGTCTCCACTCTTCCTGCC
CGTCACCCCTGGAGAGGCGGCCTCCTTGTCTTGCAAGTGCAGCCA
CAGCCTCCAACATTCAACTGGAGCCAACTATTTGGCTTGGTACCTG
CAGAGACCAGGGCAAACTCCACGCCTGTTGATCCATTTGGCCACT
CATCGGGCCTCCGGGGTCCCTGACAGATTCAGTGGCAGTGGATCA
GGCACAGATTTTACACTTAAAATCAGTCGAGTGGAGTCTGACGAT
GTTGGAACTTATTATTGCATGCAGGGTCTGCACAGTCCCTGGACG
TTCGGCCAAGGGACCAAGGTGGAGATCAAACGTACGGTGGCTGCAC
CATCTGTCTTCATCTTCCCGCCATCTGATGAGCAGTTGAAATCTGGAAC
TGCCTCTGTTGTGTGCCTGCTGAATAACTTCTATCCCAGAGAGGCCAAA
GTACAGTGGAAGGTGGATAACGCCCTCCAATCGGGTAACTCCCAGGAG
AGTGTCACAGAGCAGGACAGCAAGGACAGCACCTACAGCCTCAGCAG
CACCCTGACGCTGAGCAAAGCAGACTACGAGAAACACAAAGTCTACG

-continued

```
CCTGCGAAGTCACCCATCAGGGCCTGAGCTCGCCCGTCACAAAGAGCT

TCAACAGGGGAGAGTGTTAG
```

4995_P16 (PGT-145) kappa light chain variable region nucleotide sequence:

```
                                   (SEQ ID NO: 384)
GAGGTTGTCATAACTCAGTCTCCACTCTTCCTGCCCGTCACCCCTGGAG

AGGCGGCCTCCTTGTCTTGCAAGTGCAGCCACAGCCTCCAACATTCAA

CTGGAGCCAACTATTTGGCTTGGTACCTGCAGAGACCAGGGCAAACTC

CACGCCTGTTGATCCATTTGGCCACTCATCGGGCCTCCGGGGTCCCTGA

CAGATTCAGTGGCAGTGGATCAGGCACAGATTTTACACTTAAAATCAG

TCGAGTGGAGTCTGACGATGTTGGAACTTATTATTGCATGCAGGGTCT

GCACAGTCCCTGGACGTTCGGCCAAGGGACCAAGGTGGAGATCAAA
```

4995_P16 (PGT-145) kappa light chain amino acid sequence: expressed protein with leader sequence in italics and variable region in bold.

```
                                   (SEQ ID NO: 385)
MRLPAQLLGLLMLWVSGSGAEVVITQSPLFLPVTPGEAASLSCKCSHSLQ

HSTGANYLAWYLQRPGQTPRLLIHLATHRASGVPDRFSGSGSGTDFT

LKISRVESDDVGTYYCMQGLHSPWTFGQGTKVEIKRTVAAPSVFIFPPS

DEQLKSGTASVVCLLNNFYPREAKVQWKVDNALQSGNSQESVTEQDSKD

STYSLSSTLTLSKADYEKHKVYACEVTHQGLSSPVTKSFNRGEC
```

4995_P16 (PGT-145) kappa light chain variable region amino acid sequence: (Kabat CDRs underlined, Chothia CDRs in bold italics)

```
                                   (SEQ ID NO: 386)
EVVITQSPLFLPVTPGEAASLSCKCSHSLQHSTGANYLAWYLQRPGQ

TPRLLIH LATHRASGVPDRFSGSGSGTDFTLKISRVESDDVGTYYC

MQGLHSPWTFGQGTKVEIK
```

4995_P16 (PGT-145) kappa lambda light chain Kabat CDRs:

```
                              (SEQ ID NO: 387)
        CDR 1: KCSHSLQHSTGANYLA (SEQ ID NO: 388)
        CDR 2: LATHRAS (SEQ ID NO: 389)
        CDR 3: MQGLHSPWT
```

4995_P16 (PGT-145) kappa light chain Chothia CDRs:

```
                              (SEQ ID NO: 387)
        CDR 1:    KCSHSLQHSTGANYLA (SEQ ID NO: 388)
        CDR 2:    LATHRAS (SEQ ID NO: 389)
        CDR 3:    MQGLHSPWT
```

The 5145_B14 (PGT-127) antibody includes a heavy chain variable region (SEQ ID NO: 319), encoded by the nucleic acid sequence shown in SEQ ID NO: 317, and a light chain variable region (SEQ ID NO: 330) encoded by the nucleic acid sequence shown in SEQ ID NO: 328.

The heavy chain CDRs of the 5145_B14 (PGT-127) antibody have the following sequences per Kabat definition: RCNYFWG (SEQ ID NO: 320), SLSHCRSYYNTDWT-YHNPSLKS (SEQ ID NO: 321), and FGGEVLVYRDWP-KPAWVDL (SEQ ID NO: 322). The light chain CDRs of the 5145_B14 (PGT-127) antibody have the following sequences per Kabat definition: TGTSNNFVS (SEQ ID NO: 325), EVNKRPS (SEQ ID NO: 227), and SSLVGNWDVI (SEQ ID NO: 212).

The heavy chain CDRs of the 5145_B14 (PGT-127) antibody have the following sequences per Chothia definition: GDSTGRCN (SEQ ID NO: 323), SLSHCRSYYNT-DWTY (SEQ ID NO: 324), and FGGEVLVYRDWPK-PAWVDL (SEQ ID NO: 322). The light chain CDRs of the 5145_B14 (PGT-127) antibody have the following sequences per Chothia definition: TGTSNNFVS (SEQ ID NO: 325), EVNKRPS (SEQ ID NO: 227), and SSLVGN-WDVI (SEQ ID NO: 212).

The 5114_A19 (PGT-128) antibody includes a heavy chain variable region (SEQ ID NO: 334), encoded by the nucleic acid sequence shown in SEQ ID NO: 332, and a light chain variable region (SEQ ID NO: 393) encoded by the nucleic acid sequence shown in SEQ ID NO: 391.

The heavy chain CDRs of the 5114_A19 (PGT-128) antibody have the following sequences per Kabat definition: ACNSFWG (SEQ ID NO: 326), SLSHCASYWNRGWT-YHNPSLKS (SEQ ID NO: 335), and FGGEVLRYTDWP-KPAWVDL (SEQ ID NO: 336). The light chain CDRs of the 5114_A19 (PGT-128) antibody have the following sequences per Kabat definition: TGTSNNFVS (SEQ ID NO: 325), DVNKRPS (SEQ ID NO: 343), GSLVGNWDVI (SEQ ID NO: 196).

The heavy chain CDRs of the 5114_A19 (PGT-128) antibody have the following sequences per Chothia definition: GDSTAACN (SEQ ID NO: 337), SLSHCASYWN-RGWTY (SEQ ID NO: 338), FGGEVLRYTDWPK-PAWVDL (SEQ ID NO: 336)

The light chain CDRs of the 5114_A19 (PGT-128) antibody have the following sequences per Chothia definition: TGTSNNFVS (SEQ ID NO: 325), DVNKRPS (SEQ ID NO: 343), GSLVGNWDVI (SEQ ID NO: 196).

The 5136_H01 (PGT-131) antibody includes a heavy chain variable region (SEQ ID NO: 347), encoded by the nucleic acid sequence shown in SEQ ID NO: 345, and a light chain variable region (SEQ ID NO: 356) encoded by the nucleic acid sequence shown in SEQ ID NO: 354.

The heavy chain CDRs of the 5136_H01 (PGT-131) antibody have the following sequences per Kabat definition: TGHHYWG (SEQ ID NO: 348), HIHYNTAVLHNPALKS (SEQ ID NO: 349), and SGGDILYYIEWQKPHWFYP (SEQ ID NO: 350). The light chain CDRs of the 5136_H01 (PGT-131) antibody have the following sequences per Kabat definition: SGTGSDIGSWNFVS (SEQ ID NO: 357), EVN-RRRS (SEQ ID NO: 358), and SSLSGRWDIV (SEQ ID NO: 359).

The heavy chain CDRs of the 5136_H01 (PGT-131) antibody have the following sequences per Chothia definition: GDSINTGH (SEQ ID NO: 351), HIHYNTAVL (SEQ ID NO: 352), and SGGDILYYIEWQKPHWFYP (SEQ ID NO: 350). The light chain CDRs of the 5136_H01 (PGT-131) antibody have the following sequences per Chothia definition: SGTGSDIGSWNFVS (SEQ ID NO: 357), EVN-RRRS (SEQ ID NO: 358), and SSLSGRWDIV (SEQ ID NO: 359).

The 5345_I01 (PGT-137) antibody includes a heavy chain variable region (SEQ ID NO: 363), encoded by the nucleic acid sequence shown in SEQ ID NO: 361, and a light chain variable region (SEQ ID NO: 397) encoded by the nucleic acid sequence shown in SEQ ID NO: 395.

The heavy chain CDRs of the 5345_I01 (PGT-137) antibody have the following sequences per Kabat definition: GGEWGDSDYHWG (SEQ ID NO: 364), S1HWRGTTHYNAPFRG (SEQ ID NO: 365), and HKYHDIVMVVPIAGWFDP (SEQ ID NO: 366). The light chain CDRs of the 5345_I01 (PGT-137) antibody have the following sequences per Kabat definition: RASQSVKNNLA (SEQ ID NO: 372), DTSSRAS (SEQ ID NO: 373), and QQYEEWPRT (SEQ ID NO: 245).

The heavy chain CDRs of the 5345_I01 (PGT-137) antibody have the following sequences per Chothia definition: GGSIRGGEWGDSD (SEQ ID NO: 367), SIHWRGTTH (SEQ ID NO: 237), and HKYHDIVMVVPIAGWFDP (SEQ ID NO: 366). The light chain CDRs of the 5345_I01 (PGT-137) antibody have the following sequences per Chothia definition: RASQSVKNNLA (SEQ ID NO: 372), DTSSRAS (SEQ ID NO: 373), and QQYEEWPRT (SEQ ID NO: 245).

The 4995_P16 (PGT-145) antibody includes a heavy chain variable region (SEQ ID NO: 401), encoded by the nucleic acid sequence shown in SEQ ID NO: 399, and a light chain variable region (SEQ ID NO: 386) encoded by the nucleic acid sequence shown in SEQ ID NO: 384.

The heavy chain CDRs of the 4995_P16 (PGT-145) antibody have the following sequences per Kabat definition: NHDVH (SEQ ID NO: 378), WMSHEGDKTGLAQKFQG (SEQ ID NO: 379), and GSKHRLRDYFLYNEYGPNYEEWGDYLATLDV (SEQ ID NO: 380). The light chain CDRs of the 4995_P16 (PGT-145) antibody have the following sequences per Kabat definition: KCSHSLQHSTGANYLA (SEQ ID NO: 387), LATHRAS (SEQ ID NO: 388), and MQGLHSPWT (SEQ ID NO: 389).

The heavy chain CDRs of the 4995_P16 (PGT-145) antibody have the following sequences per Chothia definition: GNSFSN (SEQ ID NO: 381), WMSHEGDKTG (SEQ ID NO: 382), and GSKHRLRDYFLYNEYGPNYEEWGDYLATLDV (SEQ ID NO: 380). The light chain CDRs of the 4995_P16 (PGT-145) antibody have the following sequences per Chothia definition: KCSHSLQHSTGANYLA (SEQ ID NO: 387), LATHRAS (SEQ ID NO: 388), and MQGLHSPWT (SEQ ID NO: 389).

The sequences of additional human monoclonal antibodies were determined, including the sequences of the variable regions of the Gamma heavy and Kappa or Lambda light chains. In addition, the sequence of each of the polynucleotides encoding the antibody sequences was determined. Shown below are the polypeptide and polynucleotide sequences of the gamma heavy chains and kappa light chains, with the signal peptides at the N-terminus (or 5' end) and the constant regions at the C-terminus (or 3' end) of the variable regions, which are shown in bolded text.

4835_F12 (PGT-124) gamma heavy chain nucleotide sequence: coding sequence (leader sequence in italics, variable region in bold)

(SEQ ID NO: 402)
ATGAAACACCTGTGGTTCTTCCTCCTGCTGGTGGCAGCTCCCAGATGGGT

CCTATCCCAGGTGCAGCTGCAGGAGTCGGGCCCAGGACTGGTGAGACCTT

CGGAGACCCTGTCCGTCACCTGCATCGTCTCTGGGGGCTCCATCAGCAAT

TACTACTGGACTTGGATCCGACAGTCCCCAGGAAAGGGACTGGAGTGGAT

AGGCTATATTTCTGACAGAGAAACAACGACTTACAATCCCTCCCTCAACA

GTCGAGCCGTCATATCACGAGACACGTCGAAAAACCAATTGTCCCTACAA

TTACGTTCCGTCACCACTGCGGACACGGCCATCTATTTCTGTGCGACAGC

GCGCCGAGGACAGAGGATTTATGGAGTGGTTTCATTTGGAGAGTTCTTCT

ACTACTACTACATGGACGTCTGGGGCAAAGGGACTGCGGTCACCGTCTCC

TCAGCGTCGACCAAGGGCCCATCGGTCTTCCCTCTGGCACCATCATCCAA

GTCGACCTCTGGGGGCACAGCGGCCCTGGGCTGCCTGGTCAAGGACTACT

TCCCCGAACCGGTGACGGTGTCGTGGAACTCAGGCGCCCTGACCAGCGGC

GTGCACACCTTCCCGGCTGTCCTACAGTCCTCAGGACTCTACTCCCTCAG

CAGCGTGGTGACCGTGCCCTCCAGCAGCTTGGGCACCCAGACCTACATCT

GCAACGTGAATCACAAGCCCAGCAACACCAAGGTGGACAAGAGAGTTGAG

CCCAAATCTTGTGACAAAACTCACACATGCCCACCGTGCCCAGCACCTGA

ACTCCTGGGGGACCGTCAGTCTTCCTCTTCCCCCCAAAACCCAAGGACA

CCCTCATGATCTCCCGGACCCCTGAGGTCACATGCGTGGTGGTGGACGTG

AGCCACGAAGACCCTGAGGTCAAGTTCAACTGGTACGTGGACGGCGTGGA

GGTGCATAATGCCAAGACAAAGCCGCGGGAGGAGCAGTACAACAGCACGT

ACCGTGTGGTCAGCGTCCTCACCGTCCTGCACCAGGACTGGCTGAATGGC

AAGGAGTACAAGTGCAAGGTCTCCAACAAAGCCCTCCCAGCCCCCATCGA

GAAAACCATCTCCAAAGCCAAAGGGCAGCCCCGAGAACCACAGGTCTACA

CCCTGCCCCCATCCCGGGAGGAGATGACCAAGAACCAGGTCAGCCTGACC

TGCCTGGTCAAAGGCTTCTATCCCAGCGACATCGCCGTGGAGTGGGAGAG

CAATGGGCAGCCGGAGAACAACTACAAGACCACGCCTCCCGTGCTGGACT

CCGACGGCTCCTTCTTCCTCTATAGCAAGCTCACCGTGGACAAGAGCAGG

TGGCAGCAGGGGAACGTCTTCTCATGCTCCGTGATGCATGAGGCTCTGCA

CAACCACTACACGCAGAAGAGCCTCTCCCTGTCTCCGGGTAAATGA

4835_F12 (PGT-124) gamma heavy chain variable region nucleotide sequence:

(SEQ ID NO: 403)
CAGGTGCAGCTGCAGGAGTCGGGCCCAGGACTGGTGAGACCTTCGGAGAC

CCTGTCCGTCACCTGCATCGTCTCTGGGGGCTCCATCAGCAATTACTACT

GGACTTGGATCCGACAGTCCCCAGGAAAGGGACTGGAGTGGATAGGCTAT

ATTTCTGACAGAGAAACAACGACTTACAATCCCTCCCTCAACAGTCGAGC

CGTCATATCACGAGACACGTCGAAAAACCAATTGTCCCTACAATTACGTT

CCGTCACCACTGCGGACACGGCCATCTATTTCTGTGCGACAGCGCGCCGA

GGACAGAGGATTTATGGAGTGGTTTCATTTGGAGAGTTCTTCTACTACTA

CTACATGGACGTCTGGGGCAAAGGGACTGCGGTCACCGTCTCCTCA

4835_F12 (PGT-124) gamma heavy chain amino acid sequence: expressed protein with leader sequence in italics and variable region in bold.

(SEQ ID NO: 404)
*MKHLWFFLLLVAAPRWVLS*QVQLQESGPGLVRPSETLSVTCIVSGGSISN
YYWTWIRQSPGKGLEWIGYISDRETTTYNPSLNSRAVISRDTSKNQLSLQ
LRSVTTADTAIYFCATARRGQRIYGVVSFGEFFYYYYMDVWGKGTAVTVS
SASTKGPSVFPLAPSSKSTSGGTAALGCLVKDYFPEPVTVSWNSGALTSG
VHTFPAVLQSSGLYSLSSVVTVPSSSLGTQTYICNVNHKPSNTKVDKRVE
PKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNG
KEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSR
WQQGNVFSCSVMHEALHNHYTQKSLSLSPGK

4835_F12 (PGT-124) gamma heavy chain variable region amino acid sequence: (Kabat CDRs underlined, Chothia CDRs in bold italics)

(SEQ ID NO: 405)
QVQLQESGPGLVRPSETLSVTCIVS*GGSISN*YYWTWIRQSPGK
GLEWIG *YISDRETTT*YNPSLNSRAVISRDTSKNQLSLQLRS
VTTADTAIYFCAT *ARRGQRIYGVVSFGEFFYYYYMDV*WGKG
TAVTVSS

4835_F12 (PGT-124) gamma heavy chain Kabat CDRs:

| | | (SEQ ID NO: 406) |
|---|---|---|
| CDR 1: | NYYWT | |
| CDR 2: | YISDRETTTYNPSLNS | (SEQ ID NO: 407) |
| CDR 3: | ARRGQRIYGVVSFGEFFYYYYMDV | (SEQ ID NO: 408) |

4815 F12 (PGT-124) gamma heavy chain Chothia CDRs:

| | | (SEQ ID NO: 409) |
|---|---|---|
| CDR 1: | GGSISN | |
| CDR 2: | YISDRETTT | (SEQ ID NO: 410) |
| CDR 3: | ARRGQRIYGVVSFGEFFYYYYMDV | (SEQ ID NO: 408) |

4835_F12 (PGT-124) light chain nucleotide sequence: coding sequence (variable region in bold)

(SEQ ID NO: 411)
*ATGGCCTGGATCCCTCTCCTCCTCGGCCTCCTCTCTCACTGCACAGGGTC*
*TGTGAC*GTCCTATGTGAGCCCACTGTCAGTGGCCCTGGGGGAGACGGCCA
GGATTTCCTGTGGACGACAGGCCCTTGGAAGTAGAGCTGTGCAGTGGTAT
CAACATAAGCCAGGCCAGGCCCCTATTTTGCTCATCTATAATAATCAAGA
CCGGCCCTCAGGGATCCCTGAGCGGTTCTCTGGCACCCCTGATATTAATT
TTGGGACCACGGCCACCCTGACTATCAGCGGGGTCGAAGTCGGGGATGAA
GCCGACTATTACTGTCACATGTGGGACTCTAGAAGTGGTTTCAGTTGGTC
TTTCGGCGGGGCGACCAGGCTGACCGTCCTAGGTCAGCCCAAGGCTGCCC
CCTCGGTCACTCTGTTCCCGCCCTCCTCTGAGGAGCTTCAAGCCAACAAG
GCCACACTGGTGTGTCTCATAAGTGACTTCTACCCGGGAGCCGTGACAGT
GGCCTGGAAGGCAGATAGCAGCCCCGTCAAGGCGGGAGTGGAGACCACCA
CACCCTCCAAACAAAGCAACAACAAGTACGCGGCCAGCAGCTATCTGAGC
CTGACGCCTGAGCAGTGGAAGTCCCACAAAAGCTACAGCTGCCAGGTCAC
GCATGAAGGGAGCACCGTGGAGAAGACAGTGGCCCCTACAGAATGTTCAT
AG

4835_F12 (PGT-124) light chain variable region nucleotide sequence:

(SEQ ID NO: 412)
TCCTATGTGAGCCCACTGTCAGTGGCCCTGGGGGAGACGGCCAGGATTTC
CTGTGGACGACAGGCCCTTGGAAGTAGAGCTGTGCAGTGGTATCAACATA
AGCCAGGCCAGGCCCCTATTTTGCTCATCTATAATAATCAAGACCGGCCC
TCAGGGATCCCTGAGCGGTTCTCTGGCACCCCTGATATTAATTTTGGGAC
CACGGCCACCCTGACTATCAGCGGGGTCGAAGTCGGGGATGAAGCCGACT
ATTACTGTCACATGTGGGACTCTAGAAGTGGTTTCAGTTGGTCTTTCGGC
GGGGCGACCAGGCTGACCGTCCTA

4835_F12 (PGT-124) light chain amino acid sequence: expressed protein with leader sequence in italics and variable region in bold.

(SEQ ID NO: 413)
*MAWIPLLLGLLSHCTGSVT*SYVSPLSVALGETARISCGRQALGSRAVQWY
QHKPGQAPILLIYNNQDRPSGIPERFSGTPDINFGTTATLTISGVEVGDE
ADYYCHMWDSRSGFSWSFGGATRLVTVLGQPKAAPSVTLFPPSSEELQAN
KATLVCLISDFYPGAVTVAWKADSSPVKAGVETTTPSKQSNNKYAASSYL
SLTPEQWKSHKSYSCQVTHEGSTVEKTVAPTECS

4835_F12 (PGT-124) light chain variable region amino acid sequence: (Kabat CDRs underlined, Chothia CDRs in bold italics)

(SEQ ID NO: 414)
SYVSPLSVALGETARISC*GRQALGSRAVQ*WYQHKPGQAPILLIY
*NNQDRPS*GIPERFSGTPDINFGTTATLTISGVEVGDEADYYC
*HMWDSRSGFSWS*FGGATRLTVL

4835_F12 (PGT-124) light chain Kabat CDRs:

| | | (SEQ ID NO: 415) |
|---|---|---|
| CDR 1: | GRQALGSRAVQ | |
| CDR 2: | NNQDRPS | (SEQ ID NO: 151) |
| CDR 3: | HMWDSRSGFSWS | (SEQ ID NO: 416) |

4835_F12 (PGT-124) light chain Chothia CDRs:
CDR 1: GRQALGSRAVQ (SEQ ID NO: 415)
CDR 2: NNQDRPS (SEQ ID NO: 151)
CDR 3: HMWDSRSGFSWS (SEQ ID NO: 416)

4869_K15 (PGT-133) gamma heavy chain nucleotide sequence: coding sequence (variable region in bold)

(SEQ ID NO: 417)
ATGAAACACCTGTGGTTCTTCCTTCTCCTGGTGGCAGCTCCCAGATGGGT
CGTGTCC**CAGGTGCATCTGCAAGAGTCGGGGCCAGGACTGGTGACGCCTT
CGGAAACCCTGTCCCTCACTTGCACTGTGTCGAATGGCTCCGTCAGTGGT
CGCTTCTGGAGCTGGATCCGGCAGTCCCCAGGGAGAGGACTGGAATGGAT
CGGTTATTTTTCTGACACTGACAGGTCTGAATATAATCCTTCTCTCAGGA
GTCGACTCACCTTATCAGTAGATAGATCTAAGAACCAGTTGTCCCTGAGA
TTGAAGTCCGTGACCGCTGCGGATTCGGCCACTTATTACTGTGCGAGAGC
ACAGCAGGGAAGAGGATCTATGGAATAGTGTCTTTCGGAGAGTTCTTCT
ATTATTATTACATGGACGCCTGGGGCAAAGGGACTCCGGTCACCGTCTCC
TCA**GCGTCGACCAAGGGCCCATCGGTCTTCCCTCTGGCACCATCATCCAA
GTCGACCTCTGGGGGCACAGCGGCCCTGGGCTGCCTGGTCAAGGACTACT
TCCCCGAACCGGTGACGGTGTCGTGGAACTCAGGCGCCCTGACCAGCGGC
GTGCACACCTTCCCGGCTGTCCTACAGTCCTCAGGACTCTACTCCCTCAG
CAGCGTGGTGACCGTGCCCTCCAGCAGCTTGGGCACCCAGACCTACATCT
GCAACGTGAATCACAAGCCCAGCAACACCAAGGTGGACAAGAGAGTTGAG
CCCAAATCTTGTGACAAAACTCACACATGCCCACCGTGCCCAGCACCTGA
ACTCCTGGGGGGACCGTCAGTCTTCCTCTTCCCCCCAAAACCCAAGGACA
CCCTCATGATCTCCCGGACCCCTGAGGTCACATGCGTGGTGGTGGACGTG
AGCCACGAAGACCCTGAGGTCAAGTTCAACTGGTACGTGGACGGCGTGGA
GGTGCATAATGCCAAGACAAAGCCGCGGGAGGAGCAGTACAACAGCACGT
ACCGTGTGGTCAGCGTCCTCACCGTCCTGCACCAGGACTGGCTGAATGGC
AAGGAGTACAAGTGCAAGGTCTCCAACAAAGCCCTCCCAGCCCCCATCGA
GAAAACCATCTCCAAAGCCAAAGGGCAGCCCCGAGAACCACAGGTGTACA
CCCTGCCCCCATCCCGGGAGGAGATGACCAAGAACCAGGTCAGCCTGACC
TGCCTGGTCAAAGGCTTCTATCCCAGCGACATCGCCGTGGAGTGGGAGAG
CAATGGGCAGCCGGAGAACAACTACAAGACCACGCCTCCCGTGCTGGACT
CCGACGGCTCCTTCTTCCTCTATAGCAAGCTCACCGTGGACAAGAGCAGG
TGGCAGCAGGGGAACGTCTTCTCATGCTCCGTGATGCATGAGGCTCTGCA
CAACCACTACACGCAGAAGAGCCTCTCCCTGTCTCCGGGTAAATGA

4869_K15 (PGT-1331 gamma heavy chain variable region nucleotide sequence:

(SEQ ID NO: 418)
CAGGTGCATCTGCAAGAGTCGGGGCCAGGACTGGTGACGCCTTCGGAAAC
CCTGTCCCTCACTTGCACTGTGTCGAATGGCTCCGTCAGTGGTCGCTTCT
GGAGCTGGATCCGGCAGTCCCCAGGGAGAGGACTGGAATGGATCGGTTAT
TTTTCTGACACTGACAGGTCTGAATATAATCCTTCTCTCAGGAGTCGACT
CACCTTATCAGTAGATAGATCTAAGAACCAGTTGTCCCTGAGATTGAAGT
CCGTGACCGCTGCGGATTCGGCCACTTATTACTGTGCGAGAGCACAGCAG
GGGAAGAGGATCTATGGAATAGTGTCTTTCGGAGAGTTCTTCTATTATTA
TTACATGGACGCCTGGGGCAAAGGGACTCCGGTCACCGTCTCCTCA

4869_K15 (PGT-133) gamma heavy chain amino acid sequence: expressed protein with leader sequence in italics and variable region in bold.

(SEQ ID NO: 419)
*MKHLWFFLLLVAAPRWVVS***QVHLQESGPGLVTPSETLSLTCTVSNGSVS
GRFWSWIRQSPGRGLEWIGYFSDTDRSEYNPSLRSRLTLSVDRSKNQL
SLRLKSVTAADSATYYCARAQQGKRIYGIVSFGEFFYYYYMDAWGKG
TPVTVSS**ASTKGPSVFPLAPSSKSTSGGTAALGCLVKDYFPEPVTVSWNS
GALTSGVHTFPAVLQSSGLYSLSSVVTVPSSSLGTQTYICNVNHKPSNTK
VDKRVEPKSCDKTHTCPPCPAPELLGGPSVFLFPPKPKDTLMISRTPEVT
CVVVDVSHEDPEVKFNWYVDGVEVHNAKTKPREEQYNSTYRVVSVLTVLH
QDWLNGKEYKCKVSNKALPAPIEKTISKAKGQPREPQVYTLPPSREEMTK
NQVSLTCLVKGFYPSDIAVEWESNGQPENNYKTTPPVLDSDGSFFLYSKL
TVDKSRWQQGNVFSCSVMHEALHNHYTQKSLSLSPGK

4869_K15 (PGT-133) gamma heavy chain variable region amino acid sequence: (Kabat CDRs underlined, Chothia CDRs in bold italics)

(SEQ ID NO: 420)
QVHLQESGPGLVTPSETLSLTCTVS*NGSVS*G̲R̲F̲W̲S̲WIRQSPGRGLEW
IG*YFSDTDRSE*Y̲N̲P̲S̲L̲R̲S̲RLTLSVDRSKNQLSLRLKSVTAADSATYY
CARA̲*QQGKRIYGIVSFGEFFYYYYMDA*W̲GKGTPVTVSS

4869_K15 (PGT-133) gamma heavy chain Kabat CDRs:

(SEQ ID NO: 421)
CDR 1: GRFWS (SEQ ID NO: 422)
CDR 2: YFSDTDRSEYNPSLRS (SEQ ID NO: 423)
CDR 3: AQQGKRIYGIVSFGEFFYYYYMDA

4869_K15 (PGT-133) gamma heavy chain Chothia CDRs:

(SEQ ID NO: 424)
CDR 1: NGSVSG (SEQ ID NO: 425)
CDR 2: YFSDTDRSE (SEQ ID NO: 423)
CDR 3: AQQGKRIYGIVSFGEFFYYYYMDA

4869_K15 (PGT-133) light chain nucleotide sequence: coding sequence (variable region in bold)

(SEQ ID NO: 426)
ATGGCCTGGATCCCTCTCCTCCTCGGCCTCCTCTCTCACTGCACAGGTTC

-continued

TGACACTTCGTTAAACCCACTGTCGCTGGCCCCAGGAGCGACGGCCA

AAATTCCCTGCGGAGAAAGGAGCCGTGGAAGTAGGGCTGTCCAGT

GGTATCAGCAGAAGCCAGGCCAGGCCCCCACATTGATCATTTATA

ATAATCAAGACCGGCCCGCAGGGGTCTCTGAACGATTTTCTGGCA

ATCCTGACGTCGCTATTGGGGTGACGGCCACCCTGACCATCAGTC

GGGTCGAAGTCGGGGATGAGGCCGACTATTATTGTCACTATTGGG

ACAGTAGAAGTCCCATCAGCTGGATTTTCGGCGGAGGGACCCAGC

TGACCGTCCTGGGTCAGCCCAAGGCTGCCCCCTCGGTCACTCTGTTCC

CGCCCTCCTCTGAGGAGCTTCAAGCCAACAAGGCCACACTGGTGTGTC

TCATAAGTGACTTCTACCCGGGAGCCGTGACAGTGGCCTGGAAGGCAG

ATAGCAGCCCCGTCAAGGCGGGAGTGGAGACCACCACACCCTCCAAA

CAAAGCAACAACAAGTACGCGGCCAGCAGCTATCTGAGCCTGACGCC

TGAGCAGTGGAAGTCCCACAAAAGCTACAGCTGCCAGGTCACGCATG

AAGGGAGCACCGTGGAGAAGACAGTGGCCCCTACAGAATGTTCATAG

4869_K15 (PGT-133) light chain variable region nucleotide sequence:

(SEQ ID NO: 427)
TCGTTAAACCCACTGTCGCTGGCCCCAGGAGCGACGGCCAAAATT

CCCTGCGGAGAAAGGAGCCGTGGAAGTAGGGCTGTCCAGTGGTAT

CAGCAGAAGCCAGGCCAGGCCCCCACATTGATCATTTATAATAAT

CAAGACCGGCCCGCAGGGGTCTCTGAACGATTTTCTGGCAATCCT

GACGTCGCTATTGGGGTGACGGCCACCCTGACCATCAGTCGGGTC

GAAGTCGGGGATGAGGCCGACTATTATTGTCACTATTGGGACAGT

AGAAGTCCCATCAGCTGGATTTTCGGCGGAGGGACCCAGCTGACC

GTCCTG

4869_K15 (PGT-133) light chain amino acid sequence: expressed protein with leader sequence in italics and variable region in bold.

(SEQ ID NO: 428)
*MAWIPLLLGLLSHCTGSDT*SLNPLSLAPGATAKIPCGERSRGSRAVQWYQ

QKPGQAPTLIIYNNQDRPAGVSERFSGNPDVAIGVTATLTISRVEVGDE

ADYYCHYWDSRSPISWIFGGGTQLTVLGQPKAAPSVTLFPPSSEELQAN

KATLVCLISDFYPGAVTVAWKADSSPVKAGVETTTPSKQSNNKYAASSYL

SLTPEQWKSHKSYSCQVTHEGSTVEKTVAPTECS

4869_K15 (PGT-133) light chain variable region amino acid sequence: (Kabat CDRs underlined, Chothia CDRs in bold italics)

(SEQ ID NO: 429)
SLNPLSLAPGATAKIPC*GERSRGSRAVQ*WYQQKPGQAPTLIIY*NNQDRPA*

GVSERFSGNPDVAIGVTATLTISRVEVGDEADYYC*HYWDSRSPISWI*FGG

GTQLTVL

4869_K15 (PGT-133) light chain Kabat CDRs:

(SEQ ID NO: 430)
CDR 1: GERSRGSRAVQ (SEQ ID NO: 179)
CDR 2: NNQDRPA (SEQ ID NO: 431)
CDR 3: HYWDSRSPISWI

4869_K15 (PGT-133) light chain Chothia CDRs:

(SEQ ID NO: 430)
CDR 1: GERSRGSRAVQ (SEQ ID NO: 179)
CDR 2: NNQDRPA (SEQ ID NO: 431)
CDR 3: HYWDSRSPISWI

4876_M06 (PGT-134) gamma heavy chain nucleotide sequence: coding sequence (variable region in bold)

(SEQ ID NO: 432)
ATGAAACACCTGTGGTTCTTCCTCCTGCTGGTGGCAGCTCCCAGATGGGT

CGTGTCCCAGGTGCATCTGCAAGAGTCGGGGCCAGGACTGGTGACG

CCTTCGGAAACCCTGTCCCTCACTTGCACTGTGTCGAATGGCTCC

GTCAGTGGTCGCTTCTGGAGCTGGATCCGGCAGTCCCCAGGGAGA

GGACTGGAATGGATCGGTTATTTTTCTGACACTGACAGGTCTGAA

TATAATCCTTCTCAGGAGTCGACTCACCTTATCAGTCGATAGAT

CCAAGAACCAGTTGTCCCTAAAATTGAAGTCCGTGACCGCTGCGG

ATTCGGCCACTTATTACTGTGCGAGAGCACAACAGGGGAAGAGGA

TCTATGGAATAGTGTCTTTCGGAGAGTTGTTCTATTATTATTACAT

GGACGCCTGGGGCAAAGGGACTCCGGTCACCGTCTCCTCAGCGTC

GACCAAGGGCCCATCGGTCTTCCCTCTGGCACCATCATCCAAGTCGAC

CTCTGGGGGCACAGCGGCCCTGGGCTGCCTGGTCAAGGACTACTTCCC

CGAACCGGTGACGGTGTCGTGGAACTCAGGCGCCCTGACCAGCGGCGT

GCACACCTTCCCGGCTGTCCTACAGTCCTCAGGACTCTACTCCCTCAGC

AGCGTGGTGACCGTGCCCTCCAGCAGCTTGGGCACCCAGACCTACATC

TGCAACGTGAATCACAAGCCCAGCAACACCAAGGTGGACAAGAGAGT

TGAGCCCAAATCTTGTGACAAAACTCACACATGCCCACCGTGCCCAGC

ACCTGAACTCCTGGGGGGACCGTCAGTCTTCCTCTTCCCCCCAAAACC

CAAGGACACCCTCATGATCTCCCGGACCCCTGAGGTCACATGCGTGGT

GGTGGACGTGAGCCACGAAGACCCTGAGGTCAAGTTCAACTGGTACGT

GGACGGCGTGGAGGTGCATAATGCCAAGACAAAGCCGCGGGAGGAGC

AGTACAACAGCACGTACCGTGTGGTCAGCGTCCTCACCGTCCTGCACC

AGGACTGGCTGAATGGCAAGGAGTACAAGTGCAAGGTCTCCAACAAA

GCCCTCCCAGCCCCCATCGAGAAAACCATCTCCAAAGCCAAAGGGCA

GCCCCGAGAACCACAGGTGTACACCCTGCCCCCATCCCGGGAGGAGAT

GACCAAGAACCAGGTCAGCCTGACCTGCCTGGTCAAAGGCTTCTATCC

-continued

```
CAGCGACATCGCCGTGGAGTGGGAGAGCAATGGGCAGCCGGAGAACA

ACTACAAGACCACGCCTCCCGTGCTGGACTCCGACGGCTCCTTCTTCCT

CTATAGCAAGCTCACCGTGGACAAGAGCAGGTGGCAGCAGGGGAACG

TCTTCTCATGCTCCGTGATGCATGAGGCTCTGCACAACCACTACACGCA

GAAGAGCCTCTCCCTGTCTCCGGGTAAATGA
```

4876_M06 (PGT-134) gamma heavy chain variable region nucleotide sequence:

(SEQ ID NO: 433)
```
CAGGTGCATCTGCAAGAGTCGGGGCCAGGACTGGTGACGCCTTCG

GAAACCCTGTCCCTCACTTGCACTGTGTCGAATGGCTCCGTCAGT

GGTCGCTTCTGGAGCTGGATCCGGCAGTCCCCAGGGAGAGGACTG

GAATGGATCGGTTATTTTTCTGACACTGACAGGTCTGAATATAATC

CTTCTCTCAGGAGTCGACTCACCTTATCAGTCGATAGATCCAAGAA

CCAGTTGTCCCTAAAATTGAAGTCCGTGACCGCTGCGGATTCGGC

CACTTATTACTGTGCGAGAGCACAACAGGGGAAGAGGATCTATGG

AATAGTGTCTTTCGGAGAGTTGTTCTATTATTATTACATGGACGCC

TGGGGCAAAGGGACTCCGGTCACCGTCTCCTCA
```

4876_M06 (PGT-134) gamma heavy chain amino acid sequence: expressed protein with leader sequence in italics and variable region in bold.

(SEQ ID NO: 434)
*MKHLWFFLLLVAAPRWVVS*QVHLQESGPGLVTPSETLSLTCTVSNGSVS
GRFWSWIRQSPGRGLEWIGYFSDTDRSEYNPSLRSRLTLSVDRSKNQL
SLKLKSVTAADSATYYCARAQQGKRIYGIVSFGELFYYYYMDAWGK
GTPVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNT
KVDKRVEPKSCDKTHTCPPCPAPELLGGPSVFLFPPKPKDTLMISRTPEV
TCVVVDVSHEDPEVKFNWYVDGVEVHNAKTKPREEQYNSTYRVVSVLTVL
HQDWLNGKEYKCKVSNKALPAPIEKTISKAKGQPREPQVYTLPPSREEMT
KNQVSLTCLVKGFYPSDIAVEWESNGQPENNYKTTPPVLDSDGSFFLYSK
LTVDKSRWQQGNVFSCSVMHEALHNHYTQKSLSLSPGK

4876_M06 (PGT-134) gamma heavy chain variable region amino acid sequence: (Kabat CDRs underlined, Chothia CDRs in bold italics)

(SEQ ID NO: 435)
QVHLQESGPGLVTPSETLSLTCTVS*NGSVSG*<u>RFWS</u>WIRQSPGRGLEWIG
*YFSDTDRSE*<u>YNPSLRS</u>RLTLSVDRSKNQLSLKLKSVTAADSATYYCAR
*AQQGKRIYGIVSFGELFYYYYMDA*WGKGTPVTVSS

4876_M06 (PGT-134) gamma heavy chain Kabat CDRs:

(SEQ ID NO: 421)
CDR 1: GRFWS (SEQ ID NO: 422)
CDR 2: YFSDTDRSEYNPSLRS (SEQ ID NO: 436)
CDR 3: AQQGKRIYGIVSFGELFYYYYMDA

4876_M06 (PGT-134) gamma heavy chain Chothia CDRs:

CDR1:
(SEQ ID NO: 424)
NGSVSG

CDR2:
(SEQ ID NO: 425)
YFSDTDRSE

CDR3:
(SEQ ID NO: 436)
AQQGKRIYGIVSFGELFYYYYMDA

4876_M06 (PGT-134) light chain nucleotide sequence: coding sequence (variable region in bold)

(SEQ ID NO: 437)
*ATGGCCTGGATCCCTCTCCTCCTCGGCCTCCTCTCTCACTGCACAGGTT*
*CTGACACT*TCGTTAAACCCACTGTCGCTGGCCCCGGGAGCGACGGCCA
AAATTCCCTGCGGAGAAAGGAGCCGTGGAAGTAGGGCTGTCCAGT
GGTATCAGCAGAAGCCAGGCCAGGCCCCCACATTGATCATTTATA
ATAATCAAGACCGGCCCGCAGGGGTCTCTGAACGATTTTCTGGCA
ATCCTGACGTCGCTATTGGGGTGACGGCCACCCTGACCATCAGTC
GGGTCGAAGTCGGGGATGAGGGCGACTATTATTGTCACTATTGGG
ACAGTAGAAGTCCCATCAGCTGGATTTTCGCCGGAGGGACCCAGT
TGACCGTCCTGGGTCAGCCCAAGGCTGCCCCCTCGGTCACTCTGTTCC
CGCCCTCCTCTGAGGAGCTTCAAGCCAACAAGGCCACACTGGTGTGTC
TCATAAGTGACTTCTACCCGGGAGCCGTGACAGTGGCCTGGAAGGCAG
ATAGCAGCCCCGTCAAGGCGGGAGTGGAGACCACCACACCCTCCAAA
CAAAGCAACAACAAGTACGCGGCCAGCAGCTATCTGAGCCTGACGCC
TGAGCAGTGGAAGTCCCACAAAAGCTACAGCTGCCAGGTCACGCATG
AAGGGAGCACCGTGGAGAAGACAGTGGCCCCTACAGAATGTTCATAG

4876_M06 (PGT-134) light chain variable region nucleotide sequence:

(SEQ ID NO: 438)
TCGTTAAACCCACTGTCGCTGGCCCCGGGAGCGACGGCCAAAATT
CCCTGCGGAGAAAGGAGCCGTGGAAGTAGGGCTGTCCAGTGGTAT
CAGCAGAAGCCAGGCCAGGCCCCCACATTGATCATTTATAATAAT
CAAGACCGGCCCGCAGGGGTCTCTGAACGATTTTCTGGCAATCCT
GACGTCGCTATTGGGGTGACGGCCACCCTGACCATCAGTCGGGTC
GAAGTCGGGGATGAGGGCGACTATTATTGTCACTATTGGGACAGT

AGAAGTCCCATCAGCTGGATTTTCGCCGGAGGGACCCAGTTGACC

GTCCTG

4876_M06 (PGT-134) light chain amino acid sequence: expressed protein with leader sequence in italics and variable region in bold.

(SEQ ID NO: 439)
*MAWIPLLLGLLSHCTGSDT*SLNPLSLAPGATAKIPCGERSRGSRAVQWYQ

QKPGQAPTLIIYNNQDRPAGVSERFSGNPDVAIGVTATLTISRVEVGDE

GDYYCHYWDSRSPISWIFAGGTQLTVLGQPKAAPSVTLFPPSSEELQAN

KATLVCLISDFYPGAVTVAWKADSSPVKAGVETTTPSKQSNNKYAASSYL

SLTPEQWKSHKSYSCQVTHEGSTVEKTVAPTECS

4876_M06 (PGT-134) light chain variable region amino acid sequence: (Kabat CDRs underlined. Chothia CDRs in bold italics)

(SEQ ID NO: 440)
SLNPLSLAPGATAKIPC*GERSRGSRAVQ*WYQQKPGQAPTLIIY

*NNQDRPA*GVSERFSGNPDVAIGVTATLTISRVEVGDEGDYYC

*HYWDSRSPISWI*FAGGTQLTVL

4876_M06 (PGT-134) light chain Kabat CDRs:

CDR1:
(SEQ ID NO :430)
GERSRGSRAVQ

CDR2:
(SEQ ID NO: 179)
NNQDRPA

CDR3:
(SEQ ID NO: 431)
HYWDSRSPISWI

4876_M06 (PGT-134) light chain Chothia CDRs:

CDR1:
(SEQ ID NO: 430)
GERSRGSRAVQ

CDR2:
(SEQ ID NO: 179)
NNQDRPA

CDR3:
(SEQ ID NO: 431)
HYWDSRSPISWI

5131_A17 (PGT-132) gamma heavy chain nucleotide sequence: coding sequence (variable region in bold)

(SEQ ID NO: 441)
ATGAAACACCTGTGGTTCTTCCTCCTGCTGGTGGCAGCTCCCAGATGGGT

CCTTTCCCAGGTGCAACTACAGGAGTCGGGCCCAGGACTGGTGAAG

CCTTCGGAGACCCTTTCCCTCACCTGCACTGTCTCTGGTGACTCCA

TCAACACTGGTCATCACTACTGGGGCTGGGTCCGTCAGGTCCCAG

GGAAGGGACCGGAATGGATTGCTCACATCCACTATAATACGGCTG

TCTTGCACAATCCGGCCCTCAAGAGTCGAGTCACCATTTCGATTTT

CACCCTGAAGAATCTGATTACCCTGAGGCTCAGTAATATGACCGC

CGCGGACACGGCCGTCTATTTCTGCGTTCGATCCGGCGGCGACAT

TTTATACTATAATGAGTGGCAAAAACCCCACTGGTTCTATCCCTGG

GGCCCGGGAATTTTGGTCACCGTCTCGAGCGCCTCCACCAAGGGCC

CATCGGTCTTCCCCCTGGCACCCTCCTCCAAGAGCACCTCTGGGGGCA

CAGCGGCCCTGGGCTGCCTGGTCAAGGACTACTTCCCCGAACCGGTGA

CGGTGTCGTGGAACTCAGGCGCCCTGACCAGCGGCGTGCACACCTTCC

CGGCTGTCCTACAGTCCTCAGGACTCTACTCCCTCAGCAGCGTGGTGA

CCGTGCCCTCCAGCAGCTTGGGCACCCAGACCTACATCTGCAACGTGA

ATCACAAGCCCAGCAACACCAAGGTGGACAAGAGAGTTGAGCCCAAA

TCTTGTGACAAAACTCACACATGCCCACCGTGCCCAGCACCTGAACTC

CTGGGGGGACCGTCAGTCTTCCTCTTCCCCCCAAAACCCAAGGACACC

CTCATGATCTCCCGGACCCCTGAGGTCACATGCGTGGTGGTGGACGTG

AGCCACGAAGACCCTGAGGTCAAGTTCAACTGGTACGTGGACGGCGTG

GAGGTGCATAATGCCAAGACAAAGCCGCGGGAGGAGCAGTACAACAG

CACGTACCGTGTGGTCAGCGTCCTCACCGTCCTGCACCAGGACTGGCT

GAATGGCAAGGAGTACAAGTGCAAGGTCTCCAACAAAGCCCTCCCAG

CCCCCATCGAGAAAACCATCTCCAAAGCCAAAGGGCAGCCCCGAGAA

CCACAGGTGTACACCCTGCCCCCATCCCGGGAGGAGATGACCAAGAA

CCAGGTCAGCCTGACCTGCCTGGTCAAAGGCTTCTATCCCAGCGACAT

CGCCGTGGAGTGGGAGAGCAATGGGCAGCCGGAGAACAACTACAAGA

CCACGCCTCCCGTGCTGGACTCCGACGGCTCCTTCTTCCTCTATAGCAA

GCTCACCGTGGACAAGAGCAGGTGGCAGCAGGGGAACGTCTTCTCATG

CTCCGTGATGCATGAGGCTCTGCACAACCACTACACGCAGAAGAGCCT

CTCCCTGTCTCCGGGTAAATGA

5131_A17 (PGT-132) gamma heavy chain variable region nucleotide sequence:

(SEQ ID NO: 442)
CAGGTGCAACTACAGGAGTCGGGCCCAGGACTGGTGAAGCCTTCG

GAGACCCTTTCCCTCACCTGCACTGTCTCTGGTGACTCCATCAACA

CTGGTCATCACTACTGGGGCTGGGTCCGTCAGGTCCCAGGGAAGG

GACCGGAATGGATTGCTCACATCCACTATAATACGGCTGTCTTGC

ACAATCCGGCCCTCAAGAGTCGAGTCACCATTTCGATTTTCACCCT

GAAGAATCTGATTACCCTGAGGCTCAGTAATATGACCGCCGCGGA

CACGGCCGTCTATTTCTGCGTTCGATCCGGCGGCGACATTTTATAC

TATAATGAGTGGCAAAAACCCCACTGGTTCTATCCCTGGGGCCCG

GGAATTTTGGTCACCGTCTCGAGC

5131_A17 (PGT-132) gamma heavy chain amino acid sequence: expressed protein with leader effluence in italics and variable region in bold.

(SEQ ID NO: 443)
*MKHLWFFLLLVAAPRWVLS*QVQLQESGPGLVKPSETLSLTCTVSGDSINTGHHYWGWVRQVPGKGPEWIAHIHYNTAVLHNPALKSRVTISIFTLKNLITLRLSNMTAADTAVYFCVRSGGDILYYNEWQKPHWFYPWGPGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

5131_A17 (PGT-132) gamma heavy chain variable region amino acid sequence:
(Kabat CDRs underlined, Chothia CDRs in bold italics)

(SEQ ID NO: 444)
QVQLQESGPGLVKPSETLSLTCTVS*GDS INTGH*HYWGWVRQVPGKGPEWIA*HIHYNTAVL*HNPALKSRVTISIFTLKNLITLRLSNMTAADTAVYFCVR*SGGDILYYNEWQKPHWFYP*WGPGILVTVSS

5131_A17 (PGT-132) gamma heavy chain Kabat CDRs:

CDR1:
(SEQIDNO:348)
TGHHYWG

CDR2:
(SEQIDNO:349)
HIHYNTAVLHNPALKS

CDR3:
(SEQIDNO:445)
SGGDILYYNEWQKPHWFYP

5131_A17 (PGT-132) gamma heavy chain Chothia CDRs:

CDR1:
(SEQIDNO:351)
GDSINTGH

CDR2:
(SEQIDNO:352)
HIHYNTAVL

CDR3:
(SEQIDNO:445)
SGGDILYYNEWQKPHWFYP

5131_A17 (PGT-132) light chain nucleotide sequence: coding sequence (variable region in bold)

(SEQIDNO:446)
*ATGGCCTGGGCTCTGCTCCTCCTCACCCTCCTCACTCAGGGCACAGGGT*
*CCTGGGCC*CAGTCTGCCCTGACTCAGCCTCCCTCCGCGTCCGGGTCT
CTTGGACAGTCACTCACCATCTCCTGCAGTGGAACCGCCAGTGAC
ATTGGCAGTTGGAATTTTGTCTCCTGGTATCAACAATTCCCAGGCA
GAGCCCCCAACCTCATTATTTTTGAGGTCAATAGGCGGCGATCAG
GGGTCCCTGATCGCTTCTCTGGTTCCAAGTCGGGCAATACGGCCT
CCCTGACCGTCTCTGGGCTCCGGTCTGAGGATGAGGCTGAATATT
TTTGCAGTTCCCTTTCAGGCAGGTGGGACATTGTTTTTGGCGGAG
GGACCAAGGTGACCGTCCTAGGTCAGCCCAAGGCTGCCCCCTCGGTC
ACTCTGTTCCCGCCCTCCTCTGAGGAGCTTCAAGCCAACAAGGCCACA
CTGGTGTGTCTCATAAGTGACTTCTACCCGGGAGCCGTGACAGTGGCC
TGGAAGGCAGATAGCAGCCCCGTCAAGGCGGGAGTGGAGACCACCAC
ACCCTCCAAACAAAGCAACAACAAGTACGCGGCCAGCAGCTACCTGA
GCCTGACGCCTGAGCAGTGGAAGTCCCACAAAAGCTACAGCTGCCAG
GTCACGCATGAAGGGAGCACCGTGGAGAAGACAGTGGCCCCTACAGA
ATGTTCATAG

5131_A17 (PGT-132) light chain variable region nucleotide sequence:

(SEQIDNO:447)
CAGTCTGCCCTGACTCAGCCTCCCTCCGCGTCCGGGTCTCTTGGA
CAGTCACTCACCATCTCCTGCAGTGGAACCGCCAGTGACATTGGC
AGTTGGAATTTTGTCTCCTGGTATCAACAATTCCCAGGCAGAGCCC
CCAACCTCATTATTTTTGAGGTCAATAGGCGGCGATCAGGGGTCC
CTGATCGCTTCTCTGGTTCCAAGTCGGGCAATACGGCCTCCCTGA
CCGTCTCTGGGCTCCGGTCTGAGGATGAGGCTGAATATTTTTGCA
GTTCCCTTTCAGGCAGGTGGGACATTGTTTTTGGCGGAGGGACCA
AGGTGACCGTCCTA

5131_A17 (PGT-132) light chain amino acid sequence: expressed protein with leader sequence in italics and variable region in bold.

(SEQ ID NO: 448)
*MAWALLLLTLLTQGTGSWA*QSALTQPPSASGSLGQSLTISCSGTASDIGSWNFVSWYQQFPGRAPNLIIFEVNRRRSGVPDRFSGSKSGNTASLTVSGLRSEDEAEYFCSSLSGRWDIVFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

5131_A17 (PGT-132) light chain variable region amino acid sequence: (Kabat CDRs underlined, Chothia CDRs in bold italics)

(SEQ ID NO: 449)
QSALTQPPSASGSLGQSLTISC *SGTASDIGSWNFVS*WYQQFPGRAPNLIIF *EVNRRRS*GVPDRFSGSKSGNTASLTVSGLRSEDEAEYFC *SSLSGRWDIV*FGGGTKVTVL

5131_A17 (PGT-132) light chain Kabat CDRs:

CDR 1:
SGTASDIGSWNFVS (SEQ ID NO: 450)

CDR 2:
EVNRRRS (SEQ ID NO: 358)

CDR 3:
SSLSGRWDIV (SEQ ID NO: 359)

5131_A17 (PGT-132) light chain Chothia CDRs:

CDR 1:
SGTASDIGSWNFVS (SEQ ID NO: 450)

CDR 2:
EVNRRRS (SEQ ID NO: 358)

CDR 3:
SSLSGRWDIV (SEQ ID NO: 359)

5138_G07 (PGT-138) gamma heavy chain nucleotide sequence: coding sequence (variable region in bold)

(SEQ ID NO: 451)
*ATGAAACACCTGTGGTTCTTCCTCCTGCTGGTGGCAGCTCCCAGATGGG*
*TCCTGTCCC*AGCCGCAGCTGCAGGAGTCGGGGCCAGGACTGGTGGAG
GCTTCGGAGACCCTGTCCCTCACCTGCACTGTGTCCGGCGACTCC
ACTGCTGCTTGTGACTATTTCTGGGGCTGGGTCCGGCAGCCCCCA
GGGAAGGGGCTGGAGTGGATTGGAAGTTTGTCACATTGTGCAGGT
TACTACAATAGTGGCTGGACCTACCACAACCCGTCTCTCAAGAGT
CGACTCACGATTTCACTCGACACGCCCAAGAATCAGGTCTTCCTG
AAGTTAAATTCTGTGACCGCCGCGGACACGGCCATTTACTACTGT
GCGCGATTCGGTGGCGACGTTTTGGTGTACCACGATTGGCCAAAG
CCGGCCTGGGTCGACCTCTGGGGCCGGGGAGTTTTGGTCACCGTC
TCGAGCGCCTCCACCAAGGGCCCATCGGTCTTCCCCCTGGCACCCTCC
TCCAAGAGCACCTCTGGGGGCACAGCGGCCCTGGGCTGCCTGGTCAAG
GACTACTTCCCCGAACCGGTGACGGTGTCGTGGAACTCAGGCGCCCTG
ACCAGCGGCGTGCACACCTTCCCGGCTGTCCTACAGTCCTCAGGACTC
TACTCCCTCAGCAGCGTGGTGACCGTGCCCTCCAGCAGCTTGGGCACC
CAGACCTACATCTGCAACGTGAATCACAAGCCCAGCAACACCAAGGT
GGACAAGAGAGTTGAGCCCAAATCTTGTGACAAAACTCACACATGCCC
ACCGTGCCCAGCACCTGAACTCCTGGGGGGACCGTCAGTCTTCCTCTT
CCCCCCAAAACCCAAGGACACCCTCATGATCTCCCGGACCCCTGAGGT
CACATGCGTGGTGGTGGACGTGAGCCACGAAGACCCTGAGGTCAAGTT
CAACTGGTACGTGGACGGCGTGGAGGTGCATAATGCCAAGACAAAGC
CGCGGGAGGAGCAGTACAACAGCACGTACCGTGTGGTCAGCGTCCTCA
CCGTCCTGCACCAGGACTGGCTGAATGGCAAGGAGTACAAGTGCAAG

GTCTCCAACAAAGCCCTCCCAGCCCCCATCGAGAAAACCATCTCCAAA
GCCAAAGGGCAGCCCCGAGAACCACAGGTGTACACCCTGCCCCCATCC
CGGGAGGAGATGACCAAGAACCAGGTCAGCCTGACCTGCCTGGTCAA
AGGCTTCTATCCCAGCGACATCGCCGTGGAGTGGGAGAGCAATGGGCA
GCCGGAGAACAACTACAAGACCACGCCTCCCGTGCTGGACTCCGACG
GCTCCTTCTTCCTCTATAGCAAGCTCACCGTGGACAAGAGCAGGTGGC
AGCAGGGGAACGTCTTCTCATGCTCCGTGATGCATGAGGCTCTGCACA
ACCACTACACGCAGAAGAGCCTCTCCCTGTCTCCGGGTAAATGA

5138_G07 (PGT-138) gamma heavy chain variable region nucleotide sequence:

(SEQ ID NO: 452)
CAGCCGCAGCTGCAGGAGTCGGGGCCAGGACTGGTGGAGGCTTC
GGAGACCCTGTCCCTCACCTGCACTGTGTCCGGCGACTCCACTGC
TGCTTGTGACTATTTCTGGGGCTGGGTCCGGCAGCCCCCAGGGAA
GGGGCTGGAGTGGATTGGAAGTTTGTCACATTGTGCAGGTTACTA
CAATAGTGGCTGGACCTACCACAACCCGTCTCTCAAGAGTCGACT
CACGATTTCACTCGACACGCCCAAGAATCAGGTCTTCCTGAAGTTA
AATTCTGTGACCGCCGCGGACACGGCCATTTACTACTGTGCGCGA
TTCGGTGGCGACGTTTTGGTGTACCACGATTGGCCAAAGCCGGCC
TGGGTCGACCTCTGGGGCCGGGGAGTTTTGGTCACCGTCTCGAGC

5138_G07 (PGT-138) gamma heavy chain amino acid sequence: expressed protein with leader sequence in italics and variable region in bold.

(SEQ ID NO: 453)
*MKHLWFFLLLVAAPRWVLS*QPQLQESGPGLVEASETLSLTCTVSGDSTA
ACDYFWGWVRQPPGKGLEWIGSLSHCAGYYNSGWTYHNPSLKSRLT
ISLDTPKNQVFLKLNSVTAADTAIYYCARFGGDVLVYHDWPKPAWVD
LWGRGVLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKP
SNTKVDKRVEPKSCDKTHTCPPCPAPELLGGPSVFLFPPKPKDTLMIS-
RTPE
VTCVVVDVSHEDPEVKFNWYVDGVEVHNAKTKPREEQYNSTYRVVSVL
TVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFL
YSKLTVDKSRWQQGNVFSCSVMHEALHNHYTQKSLSLSPGK

5138_G07 (PGT-138) gamma heavy chain variable region amino acid sequence:
(Kabat CDRs underlined, Chothia CDRs in bold italics)

(SEQ ID NO: 454)
QPQLQESGPGLVEASETLSLTCTV*GDSTA<u>ACD</u>*<u>YFW</u>GWVRQPPGKGLEW
IG *<u>LSHCAGYYNSGWTY</u>*<u>HNPSLKS</u>RLTISLDTPKNQVFLKLNSVTAADT
AIYYCAR*<u>FGGDVLVYHDWPKPAWVDL</u>WGRGVLVTVSS

5138_G07 (PGT-138) gamma heavy chain Kabat CDRs:

```
CDR 1:
                                    (SEQ ID NO: 201)
ACDYFWG

CDR 2:
                                    (SEQ ID NO: 455)
SLSHCAGYYNSGWTYHNPSLKS

CDR 3:
                                    (SEQ ID NO: 456)
FGGDVLVYHDWPKPAWVDL
```

5138_G07 (PGT-138) gamma heavy chain Chothia CDRs:

```
CDR 1:
                                    (SEQ ID NO: 204)
GDSTAACD

CDR 2:
                                    (SEQ ID NO: 457)
SLSHCAGYYNSGWTY

CDR 3:
                                    (SEQ ID NO: 456)
FGGDVLVYHDWPKPAWVDL
```

5138_G07 (PGT-138) light chain nucleotide sequence: coding sequence (variable region in bold)

```
                                    (SEQ ID NO: 581)
ATGGCCTGGGCTCTGCTCCTCCTCACCCTCCTCACTCAGGGCACAGGGG

CCTGGGCCCAGTCTGCCCTGACTCAGCCTCCCTCCGCGTCCGGGTCT

CCTGGACAGTCAATCACCATCTCCTGCACTGGAAATATCAATAACT

TTGTCTCCTGGTACCAACAACACCCTGGCAAGGCCCCCAAACTCG

TCATTTATGGGGTCAATAAGCGCCCCTCAGGTGTCCCTGATCGTTT

TTCTGGCTCCAAGTCTGGCAACGCGGCCTCCCTGACCGTCTCTGG

ACTCCAGACTGACGATGAGGCTGTCTATTACTGCGGCTCACTTGC

AGGCAACTGGGATGTGGTTTTCGGCGGAGGGACCAAGTTGACTGT

CCTGGGTCAGCCCATGGCTGCCCCCTCGGTCACTCTGTTCCCGCCCTCC

TCTGAGGAGCTTCAAGCCAACAAGGCCACACTGGTGTGTCTCATAAGT

GACTTCTACCCGGGAGCCGTGACAGTGGCCTGGAAGGCAGATAGCAG

CCCCGTCAAGGCGGGAGTGGAGACCACCACACCCTCCAAACAAAGCA

ACAACAAGTACGCGGCCAGCAGCTACCTGAGCCTGACGCCTGAGCAG

TGGAAGTCCCACAAAAGCTACAGCTGCCAGGTCACGCATGAAGGGAG

CACCGTGGAGAAGACAGTGGCCCCTACAGAATGTTCATAG
```

5138_G07 (PGT-138) light chain variable region nucleotide sequence:

```
                                    (SEQ ID NO: 582)
CAGTCTGCCCTGACTCAGCCTCCCTCCGCGTCCGGGTCTCCTGGA

CAGTCAATCACCATCTCCTGCACTGGAAATATCAATAACTTTGTCT

CCTGGTACCAACAACACCCTGGCAAGGCCCCCAAACTCGTCATTT

ATGGGGTCAATAAGCGCCCCTCAGGTGTCCCTGATCGTTTTTCTG
```

```
GCTCCAAGTCTGGCAACGCGGCCTCCCTGACCGTCTCTGGACTCC

AGACTGACGATGAGGCTGTCTATTACTGCGGCTCACTTGCAGGCA

ACTGGGATGTGGTTTTCGGCGGAGGGACCAAGTTGACTGTCCTG
```

5138_G07 (PGT-138) light chain amino acid sequence: expressed protein with leader sequence in italics and variable region in bold.

```
                                    (SEQ ID NO: 583)
MAWALLLLTLLTQGTGAWAQSALTQPPSASGSPGQSITISCTGNINNFVSW

YQQHPGKAPKLVIYGVNKRPSGVPDRFSGSKSGNAASLTVSGLQTDD

EAVYYCGSLAGNWDVVFGGGTKLTVLGQPMAAPSVTLFPPSSEELQAN

KATLVCLISDFYPGAVTVAWKADSSPVKAGVETTTPSKQSNNKYAASSYL

SLTPEQWKSHKSYSCQVTHEGSTVEKTVAPTECS
```

5138_G07 (PGT-138) light chain variable region amino acid sequence: (Kabat CDRs underlined, Chothia CDRs in bold italics)

```
                                    (SEQ ID NO: 584)
QSALTQPPSASGSPGQSITISCTGNINNFVSWYQQHPGKAPKLVIY

GVNKRPSGVPDRFSGSKSGNAASLTVSGLQTDDEAVYYCGSLAGNWDVV

FGGGTKLTVL
```

5138_G07 (PGT-138) light chain Kabat CDRs:

```
CDR 1:
                                    (SEQ ID NO: 458)
TGNINNFVS

CDR 2:
                                    (SEQ ID NO: 211)
GVNKRPS

CDR 3:
                                    (SEQ ID NO: 459)
GSLAGNWDVV
```

5138_G07 (PGT-138) light chain Chothia CDRs:

```
CDR 1:
                                    (SEQ ID NO: 458)
TGNINNFVS

CDR 2:
                                    (SEQ ID NO: 211)
GVNKRPS

CDR 3:
                                    (SEQ ID NO: 459)
GSLAGNWDVV
```

5120_N10 (PGT-139) gamma heavy chain nucleotide sequence: coding sequence (variable region in bold)

```
                                    (SEQ ID NO: 460)
ATGAAAACACCTGTGGTTCTTCCTCCTGCTGGTGGCAGCTCCCAGATGGG

TCCTGTCCCAGCCGCAGCTGCAGGAGTCGGGGCCAGGACTGGTGGAG

GCTTCGGAGACCCTGTCCCTCACCTGCACTGTGTCCGGCGACTCC

ACTGCTGGTTGTGACTATTTCTGGGGCTGGGTCCGGCAGCCCCCA
```

```
GGGAAGGGGCTGGAGTGGATTGGGGGTTTGTCACATTGTGCAGGT
TACTACAATACTGGCTGGACCTACCACAACCCGTCTCTCAAGAGTC
GACTCACGATTTCACTCGACACGCCCAAGAATCAGGTCTTCCTGA
AGTTAAATTCTGTGACCGCCGCGGACACGGCCATTTACTACTGTG
CGCGATTCGACGGCGAAGTTTTGGTGTACAACGATTGGCCAAAGC
CGGCCTGGGTCGACCTCTGGGGCCGGGGAACTTTGGTCACCGTCT
CGAGCGCCTCCACCAAGGGCCCATCGGTCTTCCCCCTGGCACCCTCCT
CCAAGAGCACCTCTGGGGGCACAGCGGCCCTGGGCTGCCTGGTCAAG
GACTACTTCCCCGAACCGGTGACGGTGTCGTGGAACTCAGGCGCCCTG
ACCAGCGGCGTGCACACCTTCCCGGCTGTCCTACAGTCCTCAGGACTC
TACTCCCTCAGCAGCGTGGTGACCGTGCCCTCCAGCAGCTTGGGCACC
CAGACCTACATCTGCAACGTGAATCACAAGCCCAGCAACACCAAGGT
GGACAAGAGAGTTGAGCCCAAATCTTGTGACAAAACTCACACATGCCC
ACCGTGCCCAGCACCTGAACTCCTGGGGGACCGTCAGTCTTCCTCTT
CCCCCCAAAACCCAAGGACACCCTCATGATCTCCCGGACCCCTGAGGT
CACATGCGTGGTGGTGGACGTGAGCCACGAAGACCCTGAGGTCAAGTT
CAACTGGTACGTGGACGGCGTGGAGGTGCATAATGCCAAGACAAAGC
CGCGGGAGGAGCAGTACAACAGCACGTACCGTGTGGTCAGCGTCCTCA
CCGTCCTGCACCAGGACTGGCTGAATGGCAAGGAGTACAAGTGCAAG
GTCTCCAACAAAGCCCTCCCAGCCCCCATCGAGAAAACCATCTCCAAA
GCCAAAGGGCAGCCCCGAGAACCACAGGTGTACACCCTGCCCCCATCC
CGGGAGGAGATGACCAAGAACCAGGTCAGCCTGACCTGCCTGGTCAAA
AGGCTTCTATCCCAGCGACATCGCCGTGGAGTGGGAGAGCAATGGGCA
GCCGGAGAACAACTACAAGACCACGCCTCCCGTGCTGGACTCCGACG
GCTCCTTCTTCCTCTATAGCAAGCTCACCGTGGACAAGAGCAGGTGGC
AGCAGGGGAACGTCTTCTCATGCTCCGTGATGCATGAGGCTCTGCACA
ACCACTACACGCAGAAGAGCCTCTCCCTGTCTCCGGGTAAATGA
```

5120_N10 (PGT-139) gamma heavy chain variable region nucleotide sequence:

(SEQ ID NO: 461)
```
CAGCCGCAGCTGCAGGAGTCGGGGCCAGGACTGGTGGAGGCTTC
GGAGACCCTGTCCCTCACCTGCACTGTGTCCGGCGACTCCACTGC
TGGTTGTGACTATTTCTGGGGCTGGGTCCGGCAGCCCCCAGGGAA
GGGGCTGGAGTGGATTGGGGGTTTGTCACATTGTGCAGGTTACTA
CAATACTGGCTGGACCTACCACAACCCGTCTCTCAAGAGTCGACT
CACGATTTCACTCGACACGCCCAAGAATCAGGTCTTCCTGAAGTTA
AATTCTGTGACCGCCGCGGACACGGCCATTTACTACTGTGCGCGA
TTCGACGGCGAAGTTTTGGTGTACAACGATTGGCCAAAGCCGGCC
TGGGTCGACCTCTGGGGCCGGGGAACTTTGGTCACCGTCTCGAGC
```

5120_N10 (PGT-139) gamma heavy chain amino acid sequence: expressed protein with leader sequence in italics and variable region in bold.

(SEQ ID NO: 462)
*MKHLWFFLLLVAAPRWVLS*QPQLQESGPGLVEASETLSLTCTVSGDSTA
GCDYFWGWVRQPPGKGLEWIGGLSHCAGYYNTGWTYHNPSLKSRLTISL
DTPKNQVFLKLNSVTAADTAIYYCARFDGEVLVYNDWPKPAWVDLWGRG
TLVTVSSASTKGPSVFPLAPSSKSTSGGTAALGCLVKDYFPEPVTVSWNS
GALTSGVHTFPAVLQSSGLYSLSSVVTVPSSSLGTQTYICNVNHKPSNTK
VDKRVEPKSCDKTHTCPPCPAPELLGGPSVFLFPPKPKDTLMISRTP
EVTCVVVDVSHEDPEVKFNWYVDGVEVHNAKTKPREEQYNSTYRVVSV
LTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFF
LYSKLTVDKSRWQQGNVFSCSVMHEALHNHYTQKSLSLSPGK

5120_N10 (PGT-139) gamma heavy chain variable region amino acid sequence: (Kabat CDRs underlined, Chothia CDRs in bold italics)

(SEQ ID NO: 463)
QPQLQESGPGLVEASETLSLTCTVS*GDSTA**GCD*<u>YFWG</u>WVRQPPGKGLEW
IG*<u>GLSHCAGYYNTGWTY</u><u>HNPSLKS</u>RLTISLDTPKNQVFLKLNSVTAADT
AIYYCAR*FDGEVLVYNDWPKPAWVDL*WGRGTLVTVSS

5120_N10 (PGT-139) gamma heavy chain Kabat CDRs:

CDR 1:
(SEQ ID NO: 464)
GCDYFWG

CDR 2:
(SEQ ID NO: 202)
GLSHCAGYYNTGWTYHNPSLKS

CDR 3:
(SEQ ID NO: 465)
FDGEVLVYNDWPKPAWVDL

5120_N10 (PGT-139) gamma heavy chain Chothia CDRs:

CDR 1:
(SEQ ID NO: 466)
GDSTAGCD

CDR 2:
(SEQ ID NO: 205)
GLSHCAGYYNTGWTY

CDR 3:
(SEQ ID NO: 465)
FDGEVLVYNDWPKPAWVDL

5120_N10 (PGT-139) light chain nucleotide sequence: coding sequence (variable region in bold)

(SEQ ID NO: 467)
*ATGGCCTGGGCTCTGCTCCTCCTCACCCTCCTCACTCAGGGCACAGGG*
*GCCTGGGCC*CAGTCTGCCCTGACTCAGCCTCCCTCCGCGTCCGGGTCT
CCTGGACAGTCAATCACCATCTCCTGCACTGGAACCAGCAATAAC
TTTGTCTCCTGGTACCAGCAACACCCAGCCAAGGCCCCCAAACTC
GTCATTTATGGGGTCAATAAGCGCCCCTCAGGTGTCCCTGATCGT

```
TTTTCTGGCTCCAAGTCTGGCAACACGGCCTCCCTGACCGTCTCTG

GACTCCAGACTGACGATGAGGCTGTCTATTACTGCGGCTCACTTG

TAGGCAACTGGGATGTGATTTTCGGCGGAGGGACCAAGTTGACCG

TCCTGGGTCAGCCCATGGCTGCCCCCTCGGTCACTCTGTTCCCGCCCTC

CTCTGAGGAGCTTCAAGCCAACAAGGCCACACTGGTGTGTCTCATAAG

TGACTTCTACCCGGGAGCCGTGACAGTGGCCTGGAAGGCAGATAGCAG

CCCCGTCAAGGCGGGAGTGGAGACCACCACACCCTCCAAACAAAGCA

ACAACAAGTACGCGGCCAGCAGCTACCTGAGCCTGACGCCTGAGCAG

TGGAAGTCCCACAAAAGCTACAGCTGCCAGGTCACGCATGAAGGGAG

CACCGTGGAGAAGACAGTGGCCCCTACAGAATGTTCATAG
```

5120_N10 (PGT-139) light chain variable region nucleotide sequence:

```
                                          (SEQ ID NO: 468)
CAGTCTGCCCTGACTCAGCCTCCCTCCGCGTCCGGGTCTCCTGGA

CAGTCAATCACCATCTCCTGCACTGGAACCAGCAATAACTTTGTCT

CCTGGTACCAGCAACACCCAGCCAAGGCCCCCAAACTCGTCATTT

ATGGGGTCAATAAGCGCCCCTCAGGTGTCCCTGATCGTTTTTCTG

GCTCCAAGTCTGGCAACACGGCCTCCCTGACCGTCTCTGGACTCC

AGACTGACGATGAGGCTGTCTATTACTGCGGCTCACTTGTAGGCA

ACTGGGATGTGATTTTCGGCGGAGGGACCAAGTTGACCGTCCTG
```

5120_N10 (PGT-139) light chain amino acid sequence: expressed protein with leader sequence in italics and variable region in bold.

```
                                          (SEQ ID NO: 469)
MAWALLLLTLLTQGTGAWAQSALTQPPSASGSPGQSITISCTGTSNNFVS

WYQQHPAKAPKLVIYGVNKRPSGVPDRFSGSKSGNTASLTVSGLQTD

DEAVYYCGSLVGNWDVIFGGGTKLTVLGQPMAAPSVTLFPPSSEELQA

NKATLVCLISDFYPGAVTVAWKADSSPVKAGVETTTPSKQSNNKYAASS

YLSLTPEQWKSHKSYSCQVTHEGSTVEKTVAPTECS
```

5120_N10 (PGT-139) light chain variable region amino acid sequence: (Kabat CDRs underlined, Chothia CDRs in bold italics)

```
                                          (SEQ ID NO: 470)
QSALTQPPSASGSPGQSITISC*TGTSNNFVS*WYQQHPAKAPKLVIY

*GVNKRPS*GVPDRFSGSKSGNTASLTVSGLQTDDEAVYYC*GSLVGNWDVI*

FGGGTKLTVL
```

5120_N10 (PGT-139) light chain Kabat CDRs:

CDR 1:
(SEQ ID NO: 325)
TGTSNNFVS

CDR 2:
(SEQ ID NO: 211)
GVNKRPS

CDR 3:
(SEQ ID NO: 196)
GSLVGNWDVI

5120_N10 (PGT-139) light chain Chothia CDRs:

CDR 1:
(SEQ ID NO: 325)
TGTSNNFVS

CDR 2:
(SEQ ID NO: 211)
GVNKRPS

CDR 3:
(SEQ ID NO: 196)
GSLVGNWDVI

The 4835_J12 (PGT-124) antibody includes a heavy chain variable region (SEQ ID NO: 405), encoded by the nucleic acid sequence shown in SEQ ID NO: 403, and a light chain variable region (SEQ ID NO: 414) encoded by the nucleic acid sequence shown in SEQ ID NO: 412.

The heavy chain CDRs of the 4835_F12 (PGT-124) antibody have the following sequences per Kabat definition: NYYWT (SEQ ID NO: 406), YISDRETTTYNPSLNS (SEQ ID NO: 407), and ARRGQRIYGVVSFG-EFFYYYYMDV (SEQ ID NO: 408). The light chain CDRs of the 4835_F12 (PGT-124) antibody have the following sequences per Kabat definition: GRQALGSRAVQ (SEQ ID NO: 415), NNQDRPS (SEQ ID NO: 151), and HMWD-SRSGFSWS (SEQ ID NO: 416).

The heavy chain CDRs of the 4835_F12 (PGT-124) antibody have the following sequences per Chothia definition: GGSISN (SEQ ID NO: 409), YISDRETTT (SEQ ID NO: 410), and ARRGQRIYGVVSFGEFFYYYYMDV (SEQ ID NO: 408). The light chain CDRs of the 4835_F12 (PGT-124) antibody have the following sequences per Chothia definition: GRQALGSRAVQ (SEQ ID NO: 415), NNQDRPS (SEQ ID NO: 151), and HMWDSRSGFSWS (SEQ ID NO: 416).

The 4869_K15 (PGT-133) antibody includes a heavy chain variable region (SEQ ID NO: 420), encoded by the nucleic acid sequence shown in SEQ ID NO: 418, and a light chain variable region (SEQ ID NO: 429) encoded by the nucleic acid sequence shown in SEQ ID NO: 427.

The heavy chain CDRs of the 4869_K15 (PGT-133) antibody have the following sequences per Kabat definition: GRFWS (SEQ ID NO: 421), YFSDTDRSEYNPSLRS (SEQ ID NO: 422), and AQQGKRIYGIVSFG-EFFYYYYMDA (SEQ ID NO: 423). The light chain CDRs of the 4869_K15 (PGT-133) antibody have the following sequences per Kabat definition: GERSRGSRAVQ (SEQ ID NO: 430), NNQDRPA (SEQ ID NO: 179), and HYWDSR-SPISWI (SEQ ID NO: 431).

The heavy chain CDRs of the 4869_K15 (PGT-133) antibody have the following sequences per Chothia definition: NGSVSG (SEQ ID NO: 424), YFSDTDRSE (SEQ ID NO: 425), and AQQGKRIYGIVSFGEFFYYYYMDA (SEQ ID NO: 423). The light chain CDRs of the 4869_K15 (PGT-133) antibody have the following sequences per Chothia definition: GERSRGSRAVQ (SEQ ID NO: 430), NNQDRPA (SEQ ID NO: 179), and HYWDSRSPISWI (SEQ ID NO: 431).

The 4876_M06 (PGT-134) antibody includes a heavy chain variable region (SEQ ID NO: 435), encoded by the nucleic acid sequence shown in SEQ ID NO: 433, and a light chain variable region (SEQ ID NO: 440) encoded by the nucleic acid sequence shown in SEQ ID NO: 438.

The heavy chain CDRs of the 4876_M06 (PGT-134) antibody have the following sequences per Kabat definition: GRFWS (SEQ ID NO: 421), YFSDTDRSEYNPSLRS (SEQ ID NO: 422), and AQQGKRIYGIVSFGEL-FYYYYMDA (SEQ ID NO: 436). The light chain CDRs of the 4876_M06 (PGT-134) antibody have the following sequences per Kabat definition: GERSRGSRAVQ (SEQ ID NO: 430), NNQDRPA (SEQ ID NO: 179), and HYWDSR-SPISWI (SEQ ID NO: 431).

The heavy chain CDRs of the 4876_M06 (PGT-134) antibody have the following sequences per Chothia definition: NGSVSG (SEQ ID NO: 424), YFSDTDRSE (SEQ ID NO: 425), and AQQGKRIYGIVSFGELFYYYYMDA (SEQ ID NO: 436). The light chain CDRs of the 4876_M06 (PGT-134) antibody have the following sequences per Chothia definition: GERSRGSRAVQ (SEQ ID NO: 430), NNQDRPA (SEQ ID NO: 179), and HYWDSRSPISWI (SEQ ID NO: 431).

The 5131_A17 (PGT-132) antibody includes a heavy chain variable region (SEQ ID NO: 444), encoded by the nucleic acid sequence shown in SEQ ID NO: 442, and a light chain variable region (SEQ ID NO: 449) encoded by the nucleic acid sequence shown in SEQ ID NO: 447.

The heavy chain CDRs of the 5131_A17 (PGT-132) antibody have the following sequences per Kabat definition: TGHHYWG (SEQ ID NO: 348), HIHYNTAVLHNPALKS (SEQ ID NO: 349), and SGGDILYYNEWQKPHWFYP (SEQ ID NO: 445). The light chain CDRs of the 5131_A17 (PGT-132) antibody have the following sequences per Kabat definition: SGTASDIGSWNFVS (SEQ ID NO: 450), EVN-RRRS (SEQ ID NO: 358), and SSLSGRWDIV (SEQ ID NO: 359).

The heavy chain CDRs of the 5131_A17 (PGT-132) antibody have the following sequences per Chothia definition: GDSINTGH (SEQ ID NO: 351), HIHYNTAVL (SEQ ID NO: 352), and SGGDILYYNEWQKPHWFYP (SEQ ID NO: 445). The light chain CDRs of the 5131_A17 (PGT-132) antibody have the following sequences per Chothia definition: SGTASDIGSWNFVS (SEQ ID NO: 450), EVN-RRRS (SEQ ID NO: 358), and SSLSGRWDIV (SEQ ID NO: 359).

The 5138_G07 (PGT-138) antibody includes a heavy chain variable region (SEQ ID NO: 454), encoded by the nucleic acid sequence shown in SEQ ID NO: 452, and a light chain variable region (SEQ ID NO: 461) encoded by the nucleic acid sequence shown in SEQ ID NO: 459.

The heavy chain CDRs of the 5138_G07 (PGT-138) antibody have the following sequences per Kabat definition: ACDYFWG (SEQ ID NO: 201), SLSHCAGYYNSGWT-YHNPSLKS (SEQ ID NO: 455), and FGGDVLVYHDWP-KPAWVDL (SEQ ID NO: 456). The light chain CDRs of the 5138_G07 (PGT-138) antibody have the following sequences per Kabat definition: TGNINNFVS (SEQ ID NO: 458), GVNKRPS (SEQ ID NO: 211), and GSLAGNWDVV (SEQ ID NO: 459).

The heavy chain CDRs of the 5138_G07 (PGT-138) antibody have the following sequences per Chothia definition: GDSTAACD (SEQ ID NO: 204), SLSHCAGYYNS-GWTY (SEQ ID NO: 457), and FGGDVLVYHDWPK-PAWVDL (SEQ ID NO: 456). The light chain CDRs of the 5138_G07 (PGT-138) antibody have the following sequences per Chothia definition: TGNINNFVS (SEQ ID NO: 458), GVNKRPS (SEQ ID NO: 211), and GSLAG-NWDVV (SEQ ID NO: 459).

The 5120_N10 (PGT-139) antibody includes a heavy chain variable region (SEQ ID NO: 463), encoded by the nucleic acid sequence shown in SEQ ID NO: 461, and a light chain variable region (SEQ ID NO: 470) encoded by the nucleic acid sequence shown in SEQ ID NO: 468.

The heavy chain CDRs of the 5120_N10 (PGT-139) antibody have the following sequences per Kabat definition: GCDYFWG (SEQ ID NO: 464), GLSHCAGYYNTGWT-YHNPSLKS (SEQ ID NO: 202), and FDGEVLVYNDWP-KPAWVDL (SEQ ID NO: 465). The light chain CDRs of the 5120_N10 (PGT-139) antibody have the following sequences per Kabat definition: TGTSNNFVS (SEQ ID NO: 325), GVNKRPS (SEQ ID NO: 211), and GSLVGNWDVI (SEQ ID NO: 196).

The heavy chain CDRs of the 5120_N10 (PGT-139) antibody have the following sequences per Chothia definition: GDSTAGCD (SEQ ID NO: 466), GLSHCAGYYNT-GWTY (SEQ ID NO: 205), and FDGEVLVYNDWPK-PAWVDL (SEQ ID NO: 465). The light chain CDRs of the 5120_N10 (PGT-139) antibody have the following sequences per Chothia definition: TGTSNNFVS (SEQ ID NO: 325), GVNKRPS (SEQ ID NO: 211), and GSLVGN-WDVI (SEQ ID NO: 196).

The sequences of additional human monoclonal antibodies were determined, including the sequences of the variable regions of the Gamma heavy and Kappa or Lambda light chains. In addition, the sequence of each of the polynucleotides encoding the antibody sequences was determined. Shown below are the polypeptide and polynucleotide sequences of the gamma heavy chains and kappa light chains, with the signal peptides at the N-terminus (or 5' end) and the constant regions at the C-terminus (or 3' end) of the variable regions, which are shown in bolded text.

6831_A21 (PGT-151) gamma heavy chain nucleotide sequence: coding sequence (leader sequence in italics, variable region in bold)

(SEQ ID NO: 471)

*ATGGAAATTGGGGCTGAGCTGGGTTTTCCTCGTTGGTCTCTTAAGAGGT*

*GTCCAGTGT*CGGGTGCAGTTGGTGGAGTCGGGGGGAGGCGTGGTCCAG

CCTGGGAAGTCCGTGAGACTTTCCTGTGTAGTCTCCGATTTCCCCT

TCAGCAAGTATCCTATGTATTGGGTTCGCCAGGCTCCAGGCAAGG

GGCTGGAGTGGGTGGCAGCCATCTCCGGTGATGCCTGGCATGTGG

TCTACTCAAATTCCGTGCAGGGCCGATTTCTCGTCTCCAGGGACA

ATGTCAAGAACACTCTATATTTAGAAATGAACAGCCTGAAAATTGA

GGATACGGCCGTATATCGCTGCGCGAGAATGTTCCAGGAGTCTGG

TCCACCACGTTTGGATCGTTGGAGCGGTCGAAATTATTACTATTAT

TCTGGTATGGACGTCTGGGGCCAAGGGACCACGGTCACCGTCTCG

AGCGCCTCCACCAAGGGCCCATCGGTCTTCCCCCTGGCACCCTCCTCC

AAGAGCACCTCTGGGGGCACAGCGGCCCTGGGCTGCCTGGTCAAGGA

CTACTTCCCCGAACCGGTGACGGTGTCGTGGAACTCAGGCGCCCTGAC

CAGCGGCGTGCACACCTTCCCGGCTGTCCTACAGTCCTCAGGACTCTA

CTCCCTCAGCAGCGTGGTGACCGTGCCCTCCAGCAGCTTGGGCACCCA

GACCTACATCTGCAACGTGAATCACAAGCCCAGCAACACCAAGGTGG

ACAAGAGAGTTGAGCCCAAATCTTGTGACAAAACTCACACATGCCCAC

-continued
CGTGCCCAGCACCTGAACTCCTGGGGGGACCGTCAGTCTTCCTCTTCCC
CCCAAAACCCAAGGACACCCTCATGATCTCCCGGACCCCTGAGGTCAC
ATGCGTGGTGGTGGACGTGAGCCACGAAGACCCTGAGGTCAAGTTCAA
CTGGTACGTGGACGGCGTGGAGGTGCATAATGCCAAGACAAAGCCGC
GGGAGGAGCAGTACAACAGCACGTACCGTGTGGTCAGCGTCCTCACCG
TCCTGCACCAGGACTGGCTGAATGGCAAGGAGTACAAGTGCAAGGTCT
CCAACAAAGCCCTCCCAGCCCCCATCGAGAAAACCATCTCCAAAGCCA
AAGGGCAGCCCCGAGAACCACAGGTGTACACCCTGCCCCCATCCCGG
GAGGAGATGACCAAGAACCAGGTCAGCCTGACCTGCCTGGTCAAAGG
CTTCTATCCCAGCGACATCGCCGTGGAGTGGGAGAGCAATGGGCAGCC
GGAGAACAACTACAAGACCACGCCTCCCGTGCTGGACTCCGACGGCTC
CTTCTTCCTCTATAGCAAGCTCACCGTGGACAAGAGCAGGTGGCAGCA
GGGGAACGTCTTCTCATGCTCCGTGATGCATGAGGCTCTGCACAACCA
CTACACGCAGAAGAGCCTCTCCCTGTCTCCGGGTAAATGA 6831_A21 (PGT-151) gamma heavy chain variable region nucleotide sequence:

(SEQ ID NO: 472)
CGGGTGCAGTTGGTGGAGTCGGGGGGAGGCGTGGTCCAGCCTGG
GAAGTCCGTGAGACTTTCCTGTGTAGTCTCCGATTTCCCCTTCAGC
AAGTATCCTATGTATTGGGTTCGCCAGGCTCCAGGCAAGGGGCTG
GAGTGGGTGGCAGCCATCTCCGGTGATGCCTGGCATGTGGTCTAC
TCAAATTCCGTGCAGGGCCGATTTCTCGTCTCCAGGGACAATGTC
AAGAACACTCTATATTTAGAAATGAACAGCCTGAAAATTGAGGATA
CGGCCGTATATCGCTGCGCGAGAATGTTCCAGGAGTCTGGTCCAC
CACGTTTGGATCGTTGGAGCGGTCGAAATTATTACTATTATTCTGG
TATGGACGTCTGGGGCCAAGGGACCACGGTCACCGTCTCGAGC

6831_A21 (PGT-151) gamma heavy chain amino acid sequence: expressed protein with leader sequence in italics and variable region in bold.

(SEQ ID NO: 473)
*MELGLSWVFLVGLLRGVQC*RVQLVESGGGVVQPGKSVRLSCVVSDFPFS
KVPMYWVRQAPGKGLEWVAAISGDAWHVVYSNSVQGRFLVSRDNV
KNTLYLEMNSLKIEDTAVVRCARMFQESGPPRLDRWSGRNYYYSG
MDVWGQGTTVTVSSASTKGPSVFPLAPSSKSTSGGTAALGCLVKDYFPE
PVTVSWNSGALTSGVHTFPAVLQSSGLYSLSSVVTVPSSSLGTQTYICNV
NHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRV
VSVLTVLHQDWLNGKEYKCKVSNKALPAPIEKTISKAKGQPREPQVYTLP
PSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK

6831_A21 (PGT-151) gamma heavy chain variable region amino acid sequence:
(Kabat CDRs underlined, Chothia CDRs in bold italics)

(SEQ ID NO: 474)
RVQLVESGGGVVQPGKSVRLSCVVS*DFPFS*<u>KYPMY</u>WVRQAPGKGLEWV
AA*ISGDAWHVV*<u>YSNSVQG</u>RFLVSRDNVKNTLYLEMNSLKIEDTAVYRCA
R<u>*MFQESGPPRLDRWSGRNYYYYSGMDV*</u>WGQGTTVTVSS

6831_A21 (PGT-151) gamma heavy chain Kabat CDRs:

CDR 1:
(SEQ ID NO: 475)
KYPMY

CDR 2:
(SEQ ID NO: 476)
AISGDAWHVVYSNSVQG

CDR 3:
(SEQ ID NO: 477)
MFQESGPPRLDRWSGRNYYYYSGMDV

6831_A21 (PGT-151) gamma heavy chain Chothia CDRs:

CDR 1:
(SEQ ID NO: 478)
DFPFSK

CDR 2:
(SEQ ID NO: 479)
AISGDAWHVV

CDR 3:
(SEQ ID NO: 477)
MFQESGPPRLDRWSGRNYYYYSGMDV

6831_A21 (PGT-151) light chain nucleotide sequence: coding sequence (variable region in bold)

(SEQ ID NO: 480)
ATGAGGCTCCCTGCTCAGCTCCTGGGGCTGCTAATGCTCTGGATACCTGA
ATTCACTGCAGACATTGTGATGACCCAGACTCCTCTCTCTTTGTCCGT
CACCCCTGGACAGCCGGCCTCCATCTCCTGCAAGTCCAGTGAGAG
CCTCCGACAAAGTAATGGAAAGACCTCTTTGTATTGGTATCGGCA
GAAGCCAGGCCAGTCTCCACAACTCCTAGTGTTTGAAGTTTCTAAT
CGATTCTCTGGCGTGTCGGATAGGTTTGTTGGCAGCGGGTCAGGG
ACAGACTTCACACTGAGAATCAGCCGGGTAGAGGCTGAGGATGTT
GGATTTTATTACTGCATGCAAAGTAAAGACTTCCCACTTACATTTG
GCGGCGGGACCAAGGTGGATCTCAAACGTACGGTGGCTGCACCATC
TGTCTTCATCTTCCCGCCATCTGATGAGCAGTTGAAATCTGGAACTGCC
TCTGTTGTGTGCCTGCTGAATAACTTCTATCCCAGAGAGGCCAAAGTA
CAGTGGAAGGTGGATAACGCCCTCCAATCGGGTAACTCCCAGGAGAGT
GTCACAGAGCAGGACAGCAAGGACAGCACCTACAGCCTCAGCAGCAC
CCTGACGCTGAGCAAAGCAGACTACGAGAAACACAAAGTCTACGCCT
GCGAAGTCACCCATCAGGGCCTGAGCTCGCCCGTCACAAAGAGCTTCA
ACAGGGGAGAGTGTTAG

6831_A21 (PGT-151) light chain variable region nucleotide sequence:

(SEQ ID NO: 481)
GACATTGTGATGACCCAGACTCCTCTCTCTTTGTCCGTCACCCCTG

GACAGCCGGCCTCCATCTCCTGCAAGTCCAGTGAGAGCCTCCGAC

AAAGTAATGGAAAGACCTCTTTGTATTGGTATCGGCAGAAGCCAG

GCCAGTCTCCACAACTCCTAGTGTTTGAAGTTTCTAATCGATTCTC

TGGCGTGTCGGATAGGTTTGTTGGCAGCGGGTCAGGGACAGACTT

CACACTGAGAATCAGCCGGGTAGAGGCTGAGGATGTTGGATTTTA

TTACTGCATGCAAAGTAAAGACTTCCCACTTACATTTGGCGGCGG

GACCAAGGTGGATCTCAAA

6831_A21 (PGT-151) light chain amino acid sequence: expressed protein with leader sequence in italics and variable region in bold.

(SEQ ID NO: 482)
*MRLPAQLLGLLMLWIPEFTA*DIVMTQTPLSLSVTPGQPASISCKSSESLR

QSNGKTSLYWYRQKPGQSPQLLVFEVSNRFSGVSDRFVGSGSGTDFTL

RISRVEAEDVGFYYCMQSKDFPLTFGGGTKVDLKRTVAAPSVFIFPPSD

EQLKSGTASVVCLLNNFYPREAKVQWKVDNALQSGNSQESVTEQDSKDS

TYSLSSTLTLSKADYEKHKVYACEVTHQGLSSPVTKSFNRGEC

6831_A21 (PGT-151) light chain variable region amino acid sequence: (Kabat CDRs underlined, Chothia CDRs in bold italics)

(SEQ ID NO: 483)
DIVMTQTPLSLSVTPGQPASISC*KSSESLRQSNGKTSLY*WYRQKPGQSP

QLLVF*EVSNRFS*GVSDRFVGSGSGTDFTLRISRVEAEDVGFYYC

*MQSKDFPLT*FGGGTKVDLK

6831_A21 (PGT-151) light chain Kabat CDRs:

CDR 1:
(SEQ ID NO: 484)
KSSESLRQSNGKTSLY

CDR 2:
(SEQ ID NO: 485)
EVSNRFS

CDR 3:
(SEQ ID NO: 486)
MQSKDFPLT

6831_A21 (PGT-151) light chain Chothia CDRs:

CDR 1:
(SEQ ID NO: 484)
KSSESLRQSNGKTSLY

CDR 2:
(SEQ ID NO: 485)
EVSNRFS

CDR 3:
(SEQ ID NO: 486)
MQSKDFPLT

6889_I17 (PGT-152) gamma heavy chain nucleotide sequence: coding sequence (variable region in bold)

(SEQ ID NO: 487)
ATGGAATTGGGGCTGAGCTGGGTTTTCCTCGTTGGTCTCTTAAGAGGTG

TCCACTGTCGGGTGCAGTTGGTGGAGTCGGGGGGAGGCGTGGTCCAG

CCTGGGAAGTCCGTGAGACTTTCCTGTGTAGTCTCTGATTTCCCCT

TCAGCAAGTATCCTATGTATTGGGTTCGCCAGGCTCCAGGCAAGG

GGCTGGAGTGGGTGGCAGCCATCTCCGCTGATGCCTGGCATGTGG

TCTACTCAGGCTCCGTGCAGGGCCGATTTCTCGTCTCCAGGGACA

ACTCCAAGAACATTCTGTATTTGGAAATGAACACCCTGAAAATTGA

GGACACGGCCGTATATCGCTGCGCGAGAATGTTCCAGGAGTCTGG

TCCACCACGTTTCGATTCTTGGAGCGGTCGAAATTACTACTATTAC

TCTGGTATGGACGTCTGGGGCCAAGGGACCACGGTCACCGTCTCG

AGCGCCTCCACCAAGGGCCCATCGGTCTTCCCCCTGGCACCCTCCTCC

AAGAGCACCTCTGGGGGCACAGCGGCCCTGGGCTGCCTGGTCAAGGA

CTACTTCCCCGAACCGGTGACGGTGTCGTGGAACTCAGGCGCCCTGAC

CAGCGGCGTGCACACCTTCCCGGCTGTCCTACAGTCCTCAGGACTCTA

CTCCCTCAGCAGCGTGGTGACCGTGCCCTCCAGCAGCTTGGGCACCCA

GACCTACATCTGCAACGTGAATCACAAGCCCAGCAACACCAAGGTGG

ACAAGAGAGTTGAGCCCAAATCTTGTGACAAAACTCACACATGCCCAC

CGTGCCCAGCACCTGAACTCCTGGGGGGACCGTCAGTCTTCCTCTTCCC

CCCAAAACCCAAGGACACCCTCATGATCTCCCGGACCCCTGAGGTCAC

ATGCGTGGTGGTGGACGTGAGCCACGAAGACCCTGAGGTCAAGTTCAA

CTGGTACGTGGACGGCGTGGAGGTGCATAATGCCAAGACAAAGCCGC

GGGAGGAGCAGTACAACAGCACGTACCGTGTGGTCAGCGTCCTCACCG

TCCTGCACCAGGACTGGCTGAATGGCAAGGAGTACAAGTGCAAGGTCT

CCAACAAAGCCCTCCCAGCCCCCATCGAGAAAACCATCTCCAAAGCCA

AAGGGCAGCCCCGAGAACCACAGGTGTACACCCTGCCCCCATCCCGG

GAGGAGATGACCAAGAACCAGGTCAGCCTGACCTGCCTGGTCAAAGG

CTTCTATCCCAGCGACATCGCCGTGGAGTGGGAGAGCAATGGGCAGCC

GGAGAACAACTACAAGACCACGCCTCCCGTGCTGGACTCCGACGGCTC

CTTCTTCCTCTATAGCAAGCTCACCGTGGACAAGAGCAGGTGGCAGCA

GGGGAACGTCTTCTCATGCTCCGTGATGCATGAGGCTCTGCACAACCA

CTACACGCAGAAGAGCCTCTCCCTGTCTCCGGGTAAATGA

6889_I17 (PGT-152) gamma heavy chain variable region nucleotide sequence:

(SEQ ID NO: 488)
CGGGTGCAGTTGGTGGAGTCGGGGGGAGGCGTGGTCCAGCCTGG

GAAGTCCGTGAGACTTTCCTGTGTAGTCTCTGATTTCCCCTTCAGC

AAGTATCCTATGTATTGGGTTCGCCAGGCTCCAGGCAAGGGGCTG

GAGTGGGTGGCAGCCATCTCCGCTGATGCCTGGCATGTGGTCTAC

TCAGGCTCCGTGCAGGGCCGATTTCTCGTCTCCAGGGACAACTCC

AAGAACATTCTGTATTTGGAAATGAACACCCTGAAAATTGAGGAC

```
ACGGCCGTATATCGCTGCGCGAGAATGTTCCAGGAGTCTGGTCCA

CCACGTTTCGATTCTTGGAGCGGTCGAAATTACTACTATTACTCTG

GTATGGACGTCTGGGGCCAAGGGACCACGGTCACCGTCTCGAGC
```

6889_I17 (PGT-152) gamma heavy chain amino acid sequence: expressed protein with leader sequence in italics and variable region in bold.

(SEQ ID NO: 489)
*MELGLSWVFLVGLLRGVHC*RVQLVESGGGVVQPGKSVRLSCVVSDFPFS

KVPMYWVRQAPGKGLEWVAAISADAWHVVYSGSVQGRFLVSRDNS

KNILVLEMNTLKIEDTAVVRCARMFQESGPPRFDSWSGRNYYYYSGM

DVWGQGTTVTVSSASTKGPSVFPLAPSSKSTSGGTAALGCLVKDYFPEP

VTVSWNSGALTSGVHTFPAVLQSSGLYSLSSVVTVPSSSLGTQTYICNV

NHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK

6889_I17 (PGT-152) gamma heavy chain variable region amino acid sequence: (Kabat CDRs underlined, Chothia CDRs in bold italics)

(SEQ ID NO: 490)
RVQLVESGGGVVQPGKSVRLSCVVS*DFPFSK*<u>YPMY</u>WVRQAPGKGLEWV

A<u>A</u> *ISADAWHVV*<u>YSGSVQGRFLVSRDNSKNILYLEMNTLKIEDTAV</u>

YRCAR*MFQESGPPRFDSWSGRNYYYYSGMDV*WGQGTTVTVSS

6889_I17 (PGT-152) gamma heavy chain Kabat CDRs:

```
CDR 1:
                                    (SEQ ID NO: 475)
KYPMY

CDR 2:
                                    (SEQ ID NO: 491)
AISADAWHVVYSGSVQG

CDR 3:
                                    (SEQ ID NO: 492)
MFQESGPPRFDSWSGRNYYYYSGMDV
```

6889_I17 (PGT-152) gamma heavy chain Chothia CDRs:

```
                                    (SEQ ID NO: 478)
CDR 1:     DFPFSK (SEQ ID NO: 493)
CDR 2:     AISADAWHVV (SEQ ID NO: 492)
CDR 3:     MFQESGPPRFDSWSGRNYYYYSGMDV
```

6889_I17 (PGT-152) light chain nucleotide sequence: coding sequence (variable region in bold)

(SEQ ID NO: 494)
*ATGAGGCTCCCTGCTCAGCTCCTGGGGCTGCTAATGCTCTGGATACCTGA*

*ATTTATTGCC*GACATTGTGATGACCCAGACTCCTCTCTCTTTGTCCGTCG

ACCCTGGACAGCCGGCCTCCATCTCCTGCAAGTCCAGTCAGAGCCTCCGA

CAAAGTAATGGAAAGACCTCTTTGTATTGGTATCAGCAGAAGCCAGGCCA

GTCTCCACAACTCCTAATATTTGAAGTTTCTAATCGATTCTCTGGCGTGT

CGGATAGGTTTGTTGGCAGCGGGTCAGGGACAGACTTCACACTGAGAATC

AGCCGGGTAGAGGCTGAGGATGTTGGATTTTATTACTGCATGCAAAGTAA

AGACTTCCCACTCACCTTTGGCGGCGGGACCAAGGTGGATCTCAACCGTA

CGGTGGCTGCACCATCTGTCTTCATCTTCCCGCCATCTGATGAGCAGTTG

AAATCTGGAACTGCCTCTGTTGTGTGCCTGCTGAATAACTTCTATCCCAG

AGAGGCCAAAGTACAGTGGAAGGTGGATAACGCCCTCCAATCGGGTAACT

CCCAGGAGAGTGTCACAGAGCAGGACAGCAAGGACAGCACCTACAGCCTC

AGCAGCACCCTGACGCTGAGCAAAGCAGACTACGAGAAACACAAAGTCTA

CGCCTGCGAAGTCACCCATCAGGGCCTGAGCTCGCCCGTCACAAAGAGCT

TCAACAGGGGAGAGTGTTAG

6889_I17 (PGT-152) light chain variable region nucleotide sequence:

(SEQ ID NO: 495)
GACATTGTGATGACCCAGACTCCTCTCTCTTTGTCCGTCGACCCTGGAC

AGCCGGCCTCCATCTCCTGCAAGTCCAGTCAGAGCCTCCGACAAAGTAA

TGGAAAGACCTCTTTGTATTGGTATCAGCAGAAGCCAGGCCAGTCTCCA

CAACTCCTAATATTTGAAGTTTCTAATCGATTCTCTGGCGTGTCGGATA

GGTTTGTTGGCAGCGGGTCAGGGACAGACTTCACACTGAGAATCAGCCG

GGTAGAGGCTGAGGATGTTGGATTTTATTACTGCATGCAAAGTAAAGAC

TTCCCACTCACCTTTGGCGGCGGGACCAAGGTGGATCTCAAC

6889_I17 (PGT-152) light chain amino acid sequence: expressed protein with leader sequence in italics and variable region in bold.

(SEQ ID NO: 496)
*MRLPQSLLGLLMLWIPEFIA*DIVMTQTPLSLSVDPGQPASISCKSSQSL

RQSNGKTSLYWYQQKPGQSPQLLIFEVSNRFSGVSDRFVGSGSGTDGTL

RISRVEAEDVGFYYCMQSKDFPLTFGGGTKVDLNRTVAAPSVFIFPPSD

EQLKSGTASVVCLLNNFYPREAKVQWKVDNALQSGNSQESVTEQDSKDS

TYSLSSTLTLSKADYEKHKVYACEVTHQGLSSPVTKSFNRGEC

6889_I17 (PGT-152) light chain variable region amino acid sequence: (Kabat CDRs underlined, Chothia CDRs in bold italics)

(SEQ ID NO: 497)
DIVMTQTPLSLSVDPGQPASISC<u>*KSSQSLRQSNGKTSLY*</u>

WYQQKPGQSPQL<u>*EVSNRFS*</u>GVSDRFVGSGSGTDF

TLRISRVEAEDVGFYYC<u>*MQSKDFPLT*</u>FGGGTKVDLN

6889_I17 (PGT-152) light chain Kabat CDRs:

```
                               (SEQ ID NO: 498)
    CDR 1:      KSSQSLRQSNGKTSLY (SEQ ID NO: 485)
    CDR 2:      EVSNRFS (SEQ ID NO: 486)
    CDR 3:      MQSKDFPLT
```

6889_I17 (PGT-152) light chain Chothia CDRs:

```
                               (SEQ ID NO: 498)
    CDR 1:      KSSQSLRQSNGKTSLY (SEQ ID NO: 485)
    CDR 2:      EVSNRFS (SEQ ID NO: 486)
    CDR 3:      MQSKDFPLT
```

6891_F06 (PGT-153) gamma heavy chain nucleotide sequence: coding sequence (leader sequence in italics, variable region in bold)

```
                                         (SEQ ID NO: 499)
ATGGAATTGGGGCTGAGCTGGGTTTTCCTCGTTGCTCTCTTAAGAGGTGT
CCAGTGTCAGGTGCAGTTGGTGGAGTCGGGCGGAGGCGTGGTCCAGCCTG
GGAAGTCCCTGAGACTCTCCTGTGTAGTCTCTAATTTTCTCTTCAATAAA
CGTCACATGCACTGGGTCCGCCAGGCTCCAGGCAAGGGACTAGAGTGGAT
AGCAGTCATTTCCTCTGATGCCATTCACGTAGACTACGCAAGTTCCGTGC
GGGGCCGATCCTCATCTCCAGAGACAATTCCAAAAATAGTTTATATCTAG
ACATGAATAACCTGAAAATTGAGGACACGGCCACATATTATTGTGCAAGA
GATAGAGACGGATATGGTCCACCACAGATCCAGACTTGGAGCGGTCGATA
CCTCCACCTTTATTCTGGAATAGACGCCTGGGGCCTAGGGACCACGGTCA
CCGTCTCGAGCGCCTCCACCAAGGGCCCATCGGTCTTCCCCCTGGCACCC
TCCTCCAAGAGCACCTCTGGGGGCACAGCGGCCCTGGGCTGCCTGGTCAA
GGACTACTTCCCCGAACCGGTGACGGTGTCGTGGAACTCAGGCGCCCTGA
CCAGCGGCGTGCACACCTTCCCGGCTGTCCTACAGTCCTCAGGACTCTAC
TCCCTCAGCAGCGTGGTGACCGTGCCCTCCAGCAGCTTGGGCACCCAGAC
CTACATCTGCAACGTGAATCACAAGCCCAGCAACACCAAGGTGGACAAGA
GAGTTGAGCCCAAATCTTGTGACAAAACTCACACATGCCCACCGTGCCCA
GCACCTGAACTCCTGGGGGGACCGTCAGTCTTCCTCTTCCCCCCAAAACC
CAAGGACACCCTCATGATCTCCCGGACCCCTGAGGTCACATGCGTGGTGG
TGGACGTGAGCCACGAAGACCCTGAGGTCAAGTTCAACTGGTACGTGGAC
GGCGTGGAGGTGCATAATGCCAAGACAAAGCCGCGGGAGGAGCAGTACAA
CAGCACGTACCGTGTGGTCAGCGTCCTCACCGTCCTGCACCAGGACTGGC
TGAATGGCAAGGAGTACAAGTGCAAGGTCTCCAACAAAGCCCTCCCAGCC
CCCATCGAGAAAACCATCTCCAAAGCCAAAGGGCAGCCCCGAGAACCACA
GGTGTACACCCTGCCCCCATCCCGGGAGGAGATGACCAAGAACCAGGTCA
GCCTGACCTGCCTGGTCAAAGGCTTCTATCCCAGCGACATCGCCGTGGAG
TGGGAGAGCAATGGGCAGCCGGAGAACAACTACAAGACCACGCCTCCCGT
GCTGGACTCCGACGGCTCCTTCTTCCTCTATAGCAAGCTCACCGTGGACA
AGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAA
ATGA
```

6891_F06 (PGT-153) gamma heavy chain variable region nucleotide sequence:

```
                                         (SEQ ID NO: 500)
CAGGTGCAGTTGGTGGAGTCGGGCGGAGGCGTGGTCCAGCCTGGGAAGT
CCCTGAGACTCTCCTGTGTAGTCTCTAATTTTCTCTTCAATAAACGTCA
CATGCACTGGGTCCGCCAGGCTCCAGGCAAGGGACTAGAGTGGATAGCA
GTCATTTCCTCTGATGCCATTCACGTAGACTACGCAAGTTCCGTGCGGG
GCCGATCCCTCATCTCCAGAGACAATTCCAAAAATAGTTTATATCTAGA
CATGAATAACCTGAAAATTGAGGACACGGCCACATATTATTGTGCAAGA
GATAGAGACGGATATGGTCCACCACAGATCCAGACTTGGAGCGGTCGAT
ACCTCCACCTTTATTCTGGAATAGACGCCTGGGGCCTAGGGACCACGGT
CACCGTCTCGAGC
```

6891_F06 (PGT-153) gamma heavy chain amino acid sequence: expressed protein with leader sequence in italics and variable region in bold.

```
                                         (SEQ ID NO: 501)
MELGLSWVFLVALLRGVQCQVQLVESGGGVVQPGKSLRLSCVVSNFLFN
KRHMHWVRQAPGKGLEWIAVISSDAIHVDYASSVRGRSLISRDNSKNSL
YLDMNNLKIEDTATYYCARDRDGYGPPQIQTWSGRYLHLYSGIDAWGLG
TTVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSN
TKVDKRVEPKSCDKTHTCPPCPAPELLGGPSVFLFPPKPKDTLMISRTP
EVTCVVVDVSHEDPEVKFNWYVDGVEVHNAKTKPREEQYNSTYRVVSVL
TVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSF
FLYSKLTVDKSRWQQGNVFSCSVMHEALHNHYTQKSLSLSPGK
```

6891_F06 (PGT-153) gamma heavy chain variable region amino acid sequence: (Kabat CDRs underlined, Chothia CDRs in bold italics)

```
                                         (SEQ ID NO: 502)
QVQLVESGGGVVQPGKSLRLSCVVSNFLFNKRHMHWVRQAPGK
GLEWIA*VISSDAIHGVD*YASSVRGRSLISRDNSKNSLYLDMNN
LKIEDTATYYCAR*DRDGYGPPQIQTWSGRYLHLYSGIDA*
WGLGTTVTVSS
```

6891_F06 (PGT-153) gamma heavy chain Kabat CDRs:

CDR 1: KRHMH (SEQ ID NO: 503)

CDR 2: VISSDAIHVDYASSVRG (SEQ ID NO: 504)

CDR 3: DRDGYGPPQIQTWSGRYLHLYSGIDA (SEQ ID NO: 505)

6891_F06 (PGT-153) gamma heavy chain Chothia CDRs:

CDR 1: NFLFNK (SEQ ID NO: 506)

CDR 2: VISSDAIHVD (SEQ ID NO: 507)

CDR 3: DRDGYGPPQIQTWSGRYLHLYSGIDA (SEQ ID NO: 505)

6891_F06 (PGT-153) light chain nucleotide sequence: coding sequence (variable region in bold)

(SEQ ID NO: 508)
ATGAGGCTCCCTGCTCAGCTCCTGGGGCTGCTAATGCTCTGGATACCTGA
ATTCACTGCG**GACATTGTGCTGACCCAGAGCCCCCTCTTTCTGTCCGTCA
GTCCTGGACAGCCGGCCTCCATCTCCTGTAAGTCTAGTCAGAGCCTCCGA
CAAAGTAATGGAAAGACATATTTGTATTGGTACGTACAAAAGTCCGGCCA
GTCTCCACAACCCCTGATCCAGGAAGTTTCCATTCGCTTCTCTGGAGTGC
CAGGTAGATTCGCTGGCAGCGGATCAGGGACAGACTTCACACTGAAAATC
AGCCGGGTGGAGGCTGAAGATGTTGGAGTTTATTTCTGCATGCAAAGTAA
AGACTTTCCACTCACTTTTGGCGGAGGGACCAAGGTGGACCTCAAT**CGTA
CGGTGGCTGCACCATCTGTCTTCATCTTCCCGCCATCTGATGAGCAGTTG
AAATCTGGAACTGCCTCTGTTGTGTGCCTGCTGAATAACTTCTATCCCAG
AGAGGCCAAAGTACAGTGGAAGGTGGATAACGCCCTCCAATCGGGTAACT
CCCAGGAGAGTGTCACAGAGCAGGACAGCAAGGACAGCACCTACAGCCTC
AGCAGCACCCTGACGCTGAGCAAAGCAGACTACGAGAAACACAAAGTCTA
CGCCTGCGAAGTCACCCATCAGGGCCTGAGCTCGCCCGTCACAAAGAGCT
TCAACAGGGGAGAGTGTTAG

6891_F06 (PGT-153) light chain variable region nucleotide sequence:

(SEQ ID NO: 509)
GACATTGTGCTGACCCAGAGCCCCCTCTTTCTGTCCGTCAGTCCTGGACA
GCCGGCCTCCATCTCCTGTAAGTCTAGTCAGAGCCTCCGACAAAGTAATG
GAAAGACATATTTGTATTGGTACGTACAAAAGTCCGGCCAGTCTCCACAA
CCCCTGATCCAGGAAGTTTCCATTCGCTTCTCTGGAGTGCCAGGTAGATT
CGCTGGCAGCGGATCAGGGACAGACTTCACACTGAAAATCAGCCGGGTGG
AGGCTGAAGATGTTGGAGTTTATTTCTGCATGCAAAGTAAAGACTTTCCA
CTCACTTTTGGCGGAGGGACCAAGGTGGACCTCAAT

6891_F06 (PGT-153) light chain amino acid sequence: expressed protein with leader sequence in italics and variable region in bold.

(SEQ ID NO: 510)
*MRLPAQLLGLLMLWIPEFTA***DIVLTQSPLFLSVSPGQPASISCKSSQ
SLRQSNGKTYLYWYVQKSGQSPQPLIQEVSIRFSGVPGRFAGSGSGT
DFTLKISRVEAEDVGVYFCMQSKDFPLTFGGGTKVDLN**RTVAAPSVF
IFPPSDEQLKSGTASVVCLLNNFYPREAKVQWKVDNALQSGNSQESV
TEQDSKDSTYSLSSTLTLSKADYEKHKVYACEVTHQGLSSPVTKSFN
RGEC

6891_F06 (PGT-153) light chain variable region amino acid sequence: (Kabat CDRs underlined, Chothia CDRs in bold italics)

(SEQ ID NO: 511)
DIVLTQSPLFLSVSPGQPASISC*KSSQSLRQSNGKTYLY*WYVQKSG
QSPQPLIQ*EVSIRFS*GVPGRFAGSGSGTDFTLKISRVEAEDVGVYFC
*MQSKDFPLT*FGGGTKVDLN

6891_F06 (PGT-153) light chain Kabat CDRs:

CDR 1: KSSQSLRQSNGKTYLY (SEQ ID NO: 512)

CDR 2: EVSIRFS (SEQ ID NO: 513)

CDR 3: MQSKDFPLT (SEQ ID NO: 486)

6891_F06 (PGT-153) light chain Chothia CDRs:

CDR 1: KSSQSLRQSNGKTYLY (SEQ ID NO: 512)

CDR 2: EVSIRFS (SEQ ID NO: 513)

CDR 3: MQSKDFPLT (SEQ ID NO: 486)

6843_G20 (PGT-154) gamma heavy chain nucleotide sequence: coding sequence (variable region in bold)

(SEQ ID NO: 514)
ATGGAATTGGGGCTGAGCTGGGTTTTCCTCGTTGCTCTCTTAAGAGG
TGTCCAGTGT**CAGGTGCAGCTGGTGGAATCGGGAGGAGGCGTGGTCC
AGCCTGGAAAGTCCCTCAGACTCTCATGTGTCGTCTCTAATTTCATC
TTTAATAAATATCCTATGTATTGGGTCCGCCAGGCTCCAGGCAAGGG
GCTGGAGTGGGTGGCAGCCATCTCCGCTGATGCCTGGCATGTAGACT
ACGCAGCCTCCGTGAAGGACCGATTTCTCATCTCCAGAGACAATTCC
AAGAATGCTCTATATTTGGAAATGAACACCCTGAGAGTTGAAGACAC
GGGTATCTACTACTGTGCGAGAAATATAGAGGAGTTTAGTGTTCCAC
AGTTCGATTCTTGGAGCGGTCGAAGCTACTACCACTATTTTGGGATG

-continued
GACGTCTGGGGCCAAGGGACCACGGTCACCGTCTCGAGCGCCTCCAC

CAAGGGCCCATCGGTCTTCCCCCTGGCACCCTCCTCCAAGAGCACCT

CTGGGGGCACAGCGGCCCTGGGCTGCCTGGTCAAGGACTACTTCCCC

GAACCGGTGACGGTGTCGTGGAACTCAGGCGCCCTGACCAGCGGCGT

GCACACCTTCCCGGCTGTCCTACAGTCCTCAGGACTCTACTCCCTCA

GCAGCGTGGTGACCGTGCCCTCCAGCAGCTTGGGCACCCAGACCTAC

ATCTGCAACGTGAATCACAAGCCCAGCAACACCAAGGTGGACAAGAG

AGTTGAGCCCAAATCTTGTGACAAAACTCACACATGCCCACCGTGCC

CAGCACCTGAACTCCTGGGGGACCGTCAGTCTTCCTCTTCCCCCCA

AAACCCAAGGACACCCTCATGATCTCCCGGACCCCTGAGGTCACATG

CGTGGTGGTGGACGTGAGCCACGAAGACCCTGAGGTCAAGTTCAACT

GGTACGTGGACGGCGTGGAGGTGCATAATGCCAAGACAAAGCCGCGG

GAGGAGCAGTACAACAGCACGTACCGTGTGGTCAGCGTCCTCACCGT

CCTGCACCAGGACTGGCTGAATGGCAAGGAGTACAAGTGCAAGGTCT

CCAACAAAGCCCTCCCAGCCCCCATCGAGAAAACCATCTCCAAAGCC

AAAGGGCAGCCCCGAGAACCACAGGTGTACACCCTGCCCCCATCCCG

GGAGGAGATGACCAAGAACCAGGTCAGCCTGACCTGCCTGGTCAAAG

GCTTCTATCCCAGCGACATCGCCGTGGAGTGGGAGAGCAATGGGCAG

CCGGAGAACAACTACAAGACCACGCCTCCCGTGCTGGACTCCGACGG

CTCCTTCTTCCTCTATAGCAAGCTCACCGTGGACAAGAGCAGGTGGC

AGCAGGGGAACGTCTTCTCATGCTCCGTGATGCATGAGGCTCTGCAC

AACCACTACACGCAGAAGAGCCTCTCCCTGTCTCCGGGTAAATGA

6843_G20 (PGT-154) gamma heavy chain variable region nucleotide sequence:

(SEQ ID NO: 515)
CAGGTGCAGCTGGTGGAATCGGGAGGAGGCGTGGTCCAGCCTGGAAA

GTCCCTCAGACTCTCATGTGTCGTCTCTAATTTCATCTTTAATAAAT

ATCCTATGTATTGGGTCCGCCAGGCTCCAGGCAAGGGGCTGGAGTGG

GTGGCAGCCATCTCCGCTGATGCCTGGCATGTAGACTACGCAGCCTC

CGTGAAGGACCGATTTCTCATCTCCAGAGACAATTCCAAGAATGCTC

TATATTTGGAAATGAACACCCTGAGAGTTGAAGCACGGGTATCTAC

TACTGTGCGAGAAATATAGAGGAGTTTAGTGTTCCACAGTTCGATTC

TTGGAGCGGTCGAAGCTACTACCACTATTTTGGGATGGACGTCTGGG

GCCAAGGGACCACGGTCACCGTCTCGAGC

6843_G20 (PGT-154) gamma heavy chain amino acid sequence: expressed protein with leader sequence in italics and variable region in bold.

(SEQ ID NO: 516)
*MELGLSWVFLVALLRGVQC*QVQLVESGGGVVQPGKSLRLSCVVSNFI

FNKYPMYWVRQAPGKGLEWVAAISADAWHVDYAASVKDRFLISRDNS

KNALYLEMNTLRVEDTGIYYCARNIEEFSVPQFDSWSGRSYYHYFGM

-continued
DVWGQGTTVTVSSASTKGPSVFPLAPSSKSTSGGTAALGCLVKDYFP

EPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPR

EEQYNSTYRVVSVLTVLHQDWLNGKEYKCKVSNKALPAPIEKTISKA

KGQPREPQVYTLPPSREEMTKNQVSLTCLVKGFYPSDIAVEWESNGQ

PENNYKTTPPVLDSDGSFFLYSKLTVDKSRWQQGNVFSCSVMHEALH

NHYTQKSLSLSPGK

6843_G20 (PGT-154) gamma heavy chain variable region amino acid sequence: (Kabat CDRs underlined, Chothia CDRs in bold italics)

(SEQ ID NO: 517)
QVQLVESGGGVVQPGKSLRLSCVVS*NFIFNK*YPMYWVRQAPGKGLE

WVA*AISADAWHVD*YAASVKDRFLISRDNSKNALYLEMNTLRVEDTG

IYYCAR*NIEEFSVPQFDSWSGRSYYHYFGMDV*WGQGTTVTVSS

6843_G20 (PGT-154) gamma heavy chain Kabat CDRs:

CDR 1:
(SEQ ID NO: 475)
KYPMY

CDR 2:
(SEQ ID NO: 518)
AISADAWHVDYAASVKD

CDR 3:
(SEQ ID NO: 519)
NIEEFSVPQFDSWSGRSYYHYFGMDV

6843_G20 (PGT-154) gamma heavy chain Chothia CDRs:

CDR 1:
(SEQ ID NO: 520)
NFIFNK

CDR 2:
(SEQ ID NO: 521)
AISADAWHVD

CDR 3:
(SEQ ID NO: 519)
NIEEFSVPQFDSWSGRSYYHYFGMDV

6843_G20 (PGT-154) light chain nucleotide sequence: coding sequence (variable region in bold)

(SEQ ID NO: 522)
*ATGAGGCTCCCTGCTCAGCTCCTGGGGCTGCTAATGCTCTGGATACC*

*TGAGTTCGCTGCA*GACATTGTGATGACTCAGACTCCTGTCTCTCTGT

CCGTCAGTCTTGGACAGGCGGCCTCCATCTCCTGCAGCTCCAGTGAG

AGTCTCGGACGTGGTGATGGAAGGACCTATTTGCATTGGTACCGACA

GAAGCCAGGCCAGACTCCACAATTACTCATGTATGAAGTTTCTACTC

GATTCTCTGGAGTGTCCGACAGGTTCGCTGGCAGCGGGTCACGTACA

CAATTCACATTGAAAATTAGTCGGGTGGAGGCTGAAGATGTTGGCGT

-continued
TTATTACTGCATGCAAAGTAGAGACTTCCCAATCACTTTTGGCGGAG

GGACCAGGGTGGATCTCAAACGTACGGTGGCTGCACCATCTGTCTTC

ATCTTCCCGCCATCTGATGAGCAGTTGAAATCTGGAACTGCCTCTGT

TGTGTGCCTGCTGAATAACTTCTATCCCAGAGAGGCCAAAGTACAGT

GGAAGGTGGATAACGCCCTCCAATCGGGTAACTCCCAGGAGAGTGTC

ACAGAGCAGGACAGCAAGGACAGCACCTACGCCTCAGCAGCACCCT

GACGCTGAGCAAAGCAGACTACGAGAAACACAAAGTCTACGCCTGCG

AAGTCACCCATCAGGGCCTGAGCTCGCCCGTCACAAAGAGCTTCAAC

AGGGGAGAGTGTTAG

6843_G20 (PGT-154) light chain variable region nucleotide sequence:

(SEQ ID NO: 523)
GACATTGTGATGACTCAGACTCCTGTCTCTCTGTCCGTCAGTCTTGG

ACAGGCGGCCTCCATCTCCTGCAGCTCCAGTGAGAGTCTCGGACGTG

GTGATGGAAGGACCTATTTGCATTGGTACCGACAGAAGCCAGGCCAG

ACTCCACAATTACTCATGTATGAAGTTTCTACTCGATTCTCTGGAGT

GTCCGACAGGTTCGCTGGCAGCGGGTCACGTACACAATTCACATTGA

AAATTAGTCGGGTGGAAGCTGAAGATGTTGGCGTTTATTACTGCATG

CAAAGTAGAGACTTCCCAATCACTTTTGGCGGAGGGACCAGGGTGGA

TCTCAAA

6843_G20 (PGT-154) light chain amino acid sequence: expressed protein with leader sequence in italics and variable region in bold.

(SEQ ID NO: 524)
*MRLPAQLLGLLMLWIPEFAA*DIVMTQTPVSLSVSLGQAASISCSSSE

SLGRGDGRTYLHWYRQKPGQTPQLLMYEVSTRFSGVSDRFAGSGSRT

QFTLKISRVEAEDVGVYYCMQSRDFPITFGGGTRVDLKRTVAAPSVF

IFPPSDEQLKSGTASVVCLLNNFYPREAKVQWKVDNALQSGNSQESV

TEQDSKDSTYSLSSTLTLSKADYEKHKVYACEVTHQGLSSPVTKSFN

RGEC

6843_G20 (PGT-154) light chain variable region amino acid sequence: (Kabat CDRs underlined Chothia CDRs in bold italics)

(SEQ ID NO: 525)
DIVMTQTPVSLSVSLGQAASISC*SSSESLGRGDGRTYLH*WYRQKPGQ

TPQLLMY*EVSTRFS*GVSDRFAGSGSRTQFTLKISRVEAEDVGVYYC

*MQSRDFPIT*FGGGTRVDLK

6843_G20 (PGT-154) light chain Kabat CDRs:

CDR 1:
(SEQ ID NO: 526)
SSSESLGRGDGRTYLH

CDR 2:
(SEQ ID NO: 527)
EVSTRFS

CDR 3:
(SEQ ID NO: 528)
MQSRDFPIT

6843_G20 (PGT-154) light chain Chothia CDRs:

(SEQ ID NO: 526)
CDR 1: SSSESLGRGDGRTYLH (SEQ ID NO: 527)
CDR 2: EVSTRFS (SEQ ID NO: 528)
CDR 3: MQSRDFPIT

6892_D19 (PGT-155) gamma heavy chain nucleotide sequence: coding sequence (leader sequence in italics, variable region in bold)

(SEQ ID NO: 529)
*ATGGAATTGGGGCTGAGCTGGGTTTTCCTCGTCGTTCTCCTAAGAGGTGT*

*CCACTGT*CAGGTGCATCTGGTGGAGTCGGGGGGAGGCGTGGTCCAA

CCTGGGAAGTCCCTAAGACTCTCCTGTGAAACCTCTGGCTTCATCT

TCAACGAATATCCCATGTATTGGATCCGCCAGGCTCCAGGCAAGG

GACCGGAGTGGGTGGCCGCCATCTCCGCTGACGCCTGGCATGTGG

ACTACGCAGGCTCCGTGCGGGCCGATTTACCGTCTCCAGAGACA

ATTCTAAGAATTCTCTATATTTAGACATGAAGAGTCTGAAAGTTGA

AGACACGGCTATATATTTCTGTGCGAAAGATGGGGAGGAACACAA

GGTACCACAATTGCATTCCTGGAGCGGACGAAACTTATATCACTA

CACTGGTTTTGACGTCTGGGGCCCAGGGACCACGGTCACCGTCTC

GAGCGCCTCCACCAAGGGCCCATCGGTCTTCCCCCTGGCACCCTCCTC

CAAGAGCACCTCTGGGGGCACAGCGGCCCTGGGCTGCCTGGTCAAGG

ACTACTTCCCCGAACCGGTGACGGTGTCGTGGAACTCAGGCGCCCTGA

CCAGCGGCGTGCACACCTTCCCGGCTGTCCTACAGTCCTCAGGACTCT

ACTCCCTCAGCAGCGTGGTGACCGTGCCCTCCAGCAGCTTGGGCACCC

AGACCTACATCTGCAACGTGAATCACAAGCCCAGCAACACCAAGGTG

GACAAGAGAGTTGAGCCCAAATCTTGTGACAAAACTCACACATGCCCA

CCGTGCCCAGCACCTGAACTCCTGGGGGGACCGTCAGTCTTCCTCTTCC

CCCCAAAACCCAAGGACACCCTCATGATCTCCCGGACCCCTGAGGTCA

CATGCGTGGTGGTGGACGTGAGCCACGAAGACCCTGAGGTCAAGTTCA

ACTGGTACGTGGACGGCGTGGAGGTGCATAATGCCAAGACAAAGCCG

CGGGAGGAGCAGTACAACAGCACGTACCGTGTGGTCAGCGTCCTCACC

GTCCTGCACCAGGACTGGCTGAATGGCAAGGAGTACAAGTGCAAGGT

CTCCAACAAAGCCCTCCCAGCCCCCATCGAGAAAACCATCTCCAAAGC

CAAAGGGCAGCCCCGAGAACCACAGGTGTACACCCTGCCCCCATCCCG

GGAGGAGATGACCAAGAACCAGGTCAGCCTGACCTGCCTGGTCAAAG

GCTTCTATCCCAGCGACATCGCCGTGGAGTGGGAGAGCAATGGGCAGC

-continued
CGGAGAACAACTACAAGACCACGCCTCCCGTGCTGGACTCCGACGGCT

CCTTCTTCCTCTATAGCAAGCTCACCGTGGACAAGAGCAGGTGGCAGC

AGGGGAACGTCTTCTCATGCTCCGTGATGCATGAGGCTCTGCACAACC

ACTACACGCAGAAGAGCCTCTCCCTGTCTCCGGGTAAATGA

6892_D19 (PGT-155) gamma heavy chain variable region nucleotide sequence:

(SEQ ID NO: 530)
CAGGTGCATCTGGTGGAGTCGGGGGGAGGCGTGGTCCAACCTGG

GAAGTCCCTAAGACTCTCCTGTGAAACCTCTGGCTTCATCTTCAAC

GAATATCCCATGTATTGGATCCGCCAGGCTCCAGGCAAGGGACCG

GAGTGGGTGGCCGCCATCTCCGCTGACGCCTGGCATGTGGACTAC

GCAGGCTCCGTGCGGGGCCGATTTACCGTCTCCAGAGACAATTCT

AAGAATTCTCTATATTTAGACATGAAGAGTCTGAAAGTTGAAGACA

CGGCTATATATTTCTGTGCGAAAGATGGGGAGGAACACAAGGTAC

CACAATTGCATTCCTGGAGCGGACGAAACTTATATCACTACACTG

GTTTTGACGTCTGGGGCCCAGGGACCACGGTCACCGTCTCGAGC

6892_D19 (PGT-155) gamma heavy chain amino acid sequence: expressed protein with leader sequence in italics and variable region in bold.

(SEQ ID NO: 531)
*MELGLSWVFLVVLLRGVHC*QVHLVESGGGVVQPGKSLRLSCETSGFIFN

EYPMYWIRQAPGKGPEWVAAISADAWHVDYAGSVRGRFTVSRDNSK

NSLYLDMKSLKVEDTAIYFCAKDGEEHKVPQLHSWSGRNLYHYTGF

DVWGPGTTVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDKRVEPKSCDKTHTCPPCPAPELLGGPSVFLFPPKPKDTLMIS

RTPEVTCVVVDVSHEDPEVKFNWYVDGVEVHNAKTKPREEQYNSTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSGSF

FLYSKLTVDKSRWQQGNVFSCSVMHEALHNHYTQKSLSLSPGK

6892_D19 (PGT-155) gamma heavy chain variable region amino acid sequence:
(Kabat CDRs underlined, Chothia CDRs in bold italics)

(SEQ ID NO: 532)
QVHLVESGGGVVQPGKSLRLSCETS*GFIFNE*YPMYWIRQAPGKGPEW

VA*AISADAWHVD*YAGSVRGRFTVSRDNSKNSLYLDMKSLKVEDTAIY

FCAK*DGEEHKVPQLHSWSGRNLYHYTGFDV*WGPGTTVTVSS

6892_D19 (PGT-155) gamma heavy chain Kabat CDRs:

(SEQ ID NO: 533)
CDR 1: EYPMY (SEQ ID NO: 534)
CDR 2: AISADAWHVDYAGSVRG (SEQ ID NO: 535)
CDR 3: DGEEHKVPQLHSWSGRNLYHYTGFDV

6892_D19 (PGT-155) gamma heavy chain Chothia CDRs:

(SEQ ID NO: 536)
CDR 1: GFIFNE (SEQ ID NO: 521)
CDR 2: AISADAWHVD (SEQ ID NO: 535)
CDR 3: DGEEHKVPQLHSWSGRNLYHYTGFDV

6892_D19 (PGT-155) light chain nucleotide sequence: coding sequence (variable region in bold)

(SEQ ID NO: 537)
*ATGAGGCTCCCTGCTCAGCTCCTGGGGCTGCTAATGCTCTGGATACCTGA*

*ACTTGCTGCA*GACATTGTGATGACCCAGTCTCCTGTCTCTCTGTCCGT

CACCCTCGGACAGCCGGCCTCCATGTCCTGCAAGTCCAGTCAGAG

TGTCCGACAGAGTGATGGCAAGACTTTCTTATATTGGTATCGACA

GAAGCCAGGCCAGTCTCCACAACTGTTAATATATGAGGGTTCGAG

TCGATTCTCTGGAGTGTCAGATAGGATCTCTGGCAGCGGGTCAGG

GACAGACTTCACACTGAGGATCAGTCGAGTGGAGGCTGAGGATGC

TGGCGTTTACTTCTGCTTGCAAACTAAAGACTTCCCCCTCACTTTT

GGCGGAGGGACCAGGGTGGATCTCAAACGTACGGTGGCTGCACCAT

CTGTCTTCATCTTCCCGCCATCTGATGAGCAGTTGAAATCTGGAACTGC

CTCTGTTGTGTGCCTGCTGAATAACTTCTATCCCAGAGAGGCCAAAGT

ACAGTGGAAGGTGGATAACGCCCTCCAATCGGGTAACTCCCAGGAGA

GTGTCACAGAGCAGGACAGCAAGGACAGCACCTACAGCCTCAGCAGC

ACCCTGACGCTGAGCAAAGCAGACTACGAGAAACACAAAGTCTACGC

CTGCGAAGTCACCCATCAGGGCCTGAGCTCGCCCGTCACAAAGAGCTT

CAACAGGGGAGAGTGTTAG

6892_D19 (PGT-155) light chain variable region nucleotide sequence:

(SEQ ID NO: 538)
GACATTGTGATGACCCAGTCTCCTGTCTCTCTGTCCGTCACCCTCG

GACAGCCGGCCTCCATGTCCTGCAAGTCCAGTCAGAGTGTCCGAC

AGAGTGATGGCAAGACTTTCTTATATTGGTATCGACAGAAGCCAG

GCCAGTCTCCACAACTGTTAATATATGAGGGTTCGAGTCGATTCTC

TGGAGTGTCAGATAGGATCTCTGGCAGCGGGTCAGGGACAGACTT

CACACTGAGGATCAGTCGAGTGGAGGCTGAGGATGCTGGCGTTTA

CTTCTGCTTGCAAACTAAAGACTTCCCCCTCACTTTTGGCGGAGGG

ACCAGGGTGGATCTCAAA

6892_D19 (PGT-155) light chain amino acid sequence: expressed protein with leader sequence in italics and variable region in bold.

(SEQ ID NO: 539)
MRLPAQLLGLLMLWIPELAADIVMTQSPVSLSVTLGQPASMSCKSSQSVR
QSDGKTFLYWYRQKPGQSPQLLIYEGSSRFSGVSDRISGSGSGTDFTL
RISRVEAEDAGVYFCLQTKDFPLTFGGGTRVDLKRTVAAPSVFIFPPSD
EQLKSGTASVVCLLNNFYPREAKVQWKVDNALQSGNSQESVTEQDSKDS
TYSLSSTLTLSKADYEKHKVYACEVTHQGLSSPVTKSFNRGEC

6892_D19 (PGT-155) light chain variable region amino acid sequence: (Kabat CDRs underlined, Chothia CDRs in bold italics)

(SEQ ID NO: 540)
DIVMTQSPVSLSVTLGQPASMSC*KSSQSVRQSDGKTFLY*WYRQKPGQ
SPQLLIY*EGSSRFS*GVSDRISGSGSGTDFTLRISRVEAEDAGVYFC
*LQTKDFPLT*FGGGTRVDLK

6892_D19 (PGT-155) light chain Kabat CDRs:

(SEQ ID NO: 541)
CDR 1: KSSQSVRQSDGKTFLY (SEQ ID NO: 542)
CDR 2: EGSSRFS (SEQ ID NO: 543)
CDR 3: LQTKDFPLT

6892_D19 (PGT-155) light chain Chothia CDRs:

(SEQ ID NO: 541)
CDR 1: KSSQSVRQSDGKTFLY (SEQ ID NO: 542)
CDR 2: EGSSRFS (SEQ ID NO: 543)
CDR 3: LQTKDFPLT

6808_B09 (PGT-156) gamma heavy chain nucleotide sequence: coding sequence (variable region in bold)
ATGGAATTGGGGCTGAGCTGGGTTTTC-
CTCGTCGTTCTCCTAAGAGGTGTCCA CTGTCA-
GGTGCATCTGGTGGAGTCGGGGGGAGGCGTT-
GTCCAACCTG
GAAAGTCCCTAAGACTCTCCTGTGAAAC-
CTCTGGCTTCATCTTCAATC AATATCCCATGT-
ATTGGGTCCGCCAGGCTCCAGGCAAGGGAC-
CGGAG
TGGGTGGCCGCCATCTCCGCTGATGCCTG-
GCATGTGGACTACCCAGG CTCCGTGCGGGGC-
CGATTTACCGTCTCCAGAGACAATTC-
CAAGAGTT
CTCTATATTTAGACATGAAGAGTCTGAAAGTT-
GAAGACACGGCTATAT ATTTCTGTGC-
GAAAGATGGGGAGGAACACAAGGTACCA-
CAATTGCAT
TCCTGGAGCGGACGAAACTTATATCACTA-
CACTGGTTTTGACGTCTG GGGCCCAGGGAC-
CACGGTCACCGTCTCGAGCGCCTCCAC-
CAAGGGCC
CATCGGTCTTCCCCCTGGCACCCTCCTC-
AAGAGCACCTCTGGGGGCACA GCGGC-
CCTGGGCTGCCTGGTCAAGGACTACTTC-
CCCGAACCGGTGACGGT
GTCGTGGAACTCAGGCGCCCTGACCAGCG-
GCGTGCACACCTTCCCGGCTG TCCTACAGTC-
CTCAGGACTCTACTCCCTCAGCAGCGTGGT-
GACCGTGCCCT
CCAGCAGCTTGGGCACCCAGACCTACATCTG-
CAACGTGAATCACAAGCCC AGCAACAC-
CAAGGTGGACAAGAGAGTTGAGCCCAAATCT-
TGTGACAAAA
CTCACACATGCCCACCGTGCCCAGCACCT-
GAACTCCTGGGGGGACCGTCA GTCTTCCTCT-
TCCCCCCAAAACCCAAGGACACCCTCAT-
GATCTCCCGGACC
CCTGAGGTCACATGCGTGGTGGTGGACGT-
GAGCCACGAAGACCCTGAGGT CAAGT-
TCAACTGGTACGTGGACGGCGTGGAGGTG-
CATAATGCCAAGACA
AAGCCGCGGGAGGAGCAGTACAACAGCACG-
TACCGTGTGGTCAGCGTCC TCACCGTCCTG-
CACCAGGACTGGCTGAATGGCAAGGAGTA-
CAAGTGCAA
GGTCTCCAACAAAGCCCTCCCAGCCCCATC-
GAGAAAACCATCTCCAAAG CCAAAGGGCA-
GCCCCGAGAACCACAGGTGTACACCCTGC-
CCCCATCCCGG
GAGGAGATGACCAAGAACCAGGTCAGCCT-
GACCTGCCTGGTCAAAGGCT TCTATCCCAGC-
GACATCGCCGTGGAGTGGGAGAG-
CAATGGGCAGCCGGA
GAACAACTACAAGACCACGCCTCCCGTGCTG-
GACTCCGACGGCTCCTTCT TCCTCTATAG-
CAAGCTCACCGTGGACAAGAGCAGGTGGCA-
GCAGGGGAA
CGTCTTCTCATGCTCCGTGATGCATGAGGCTCT-
GCACAACCACTACACGC AGAAGAGCCTCTC-
CCTGTCTCCGGGTAAATGA (SEQ ID NO: 544)

6808_B09 (PGT-156) gamma heavy chain variable region nucleotide sequence:

(SEQ ID NO: 545)
CAGGTGCATCTGGTGGAGTCGGGGGGAGGCGTTGTCCAACCTGG

AAAGTCCCTAAGACTCTCCTGTGAAACCTCTGGCTTCATCTTCAAT

CAATATCCCATGTATTGGGTCCGCCAGGCTCCAGGCAAGGGACCG

GAGTGGGTGGCCGCCATCTCCGCTGATGCCTGGCATGTGGACTAC

CCAGGCTCCGTGCGGGGCCGATTTACCGTCTCCAGAGACAATTCC

AAGAGTTCTCTATATTTAGACATGAAGAGTCTGAAAGTTGAAGACA

CGGCTATATATTTCTGTGCGAAAGATGGGGAGGAACACAAGGTAC

CACAATTGCATTCCTGGAGCGGACGAAACTTATATCACTACACTG

GTTTTGACGTCTGGGGCCCAGGGACCACGGTCACCGTCTCGAGC

6808_B09 (PGT-156) gamma heavy chain amino acid sequence: expressed protein with leader sequence in italics and variable region in bold.

(SEQ ID NO: 546)
*MELGLSWVFLVVLLRGVHC*QVHLVESGGGVVQPGKSLRLSCETSGFI

FNQYPMYWVRQAPGKGPEWVAAISADAWHVDYPGSVRGRFTVSRDNS

KSSLYLDMKSLKVEDTAIYFCAKDGEEHKVPQLHSWSGRNLYHYTGF

DVWGPGTTVTVSSASTKGPSVFPLAPSSKSTSGGTAALGCLVKDYFP

EPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPR

EEQYNSTYRVVSVLTVLHQDWLNGKEYKCKVSNKALPAPIEKTISKA

KGQPREPQVYTLPPSREEMTKNQVSLTCLVKGFYPSDIAVEWESNGQ

PENNYKTTPPVLDSDGSFFLYSKLTVDKSRWQQGNVFSCSVMHEALH

NHYTQKSLSLSPGK

6808_B09 (PGT-156) gamma heavy chain variable region amino acid sequence: (Kabat CDRs underlined, Chothia CDRs in bold italics)

(SEQ ID NO: 547)
QVHLVESGGGVVQPGKSLRLSCETS*GFIFNQ*<u>YPMY</u>WVRQAPGKGPE

WVA*AISADAWHVD*<u>YPGSVRG</u>RFTVSRDNSKSSLYLDMKSLKVEDTA

IYFCAK<u>*DGEEHKVPQLHSWSGRNLYHYTGFDV*</u>WGPGTTVTVSS

6808_B09 (PGT-156) gamma heavy chain Kabat CDRs:

```
CDR 1:
                                    (SEQ ID NO: 548)
QYPMY

CDR 2:
                                    (SEQ ID NO: 549)
AISADAWHVDYPGSVRG

CDR 3:
                                    (SEQ ID NO: 535)
DGEEHKVPQLHSWSGRNLYHYTGFDV
```

6808B09 (PGT-156) gamma heavy chain Chothia CDRs:

```
CDR 1:
                                    (SEQ ID NO: 550)
GFIFNQ

CDR 2:
                                    (SEQ ID NO: 521)
AISADAWHVD

CDR 3:
                                    (SEQ ID NO: 535)
DGEEHKVPQLHSWSGRNLYHYTGFDV
```

6808_B09 (PGT-156) light chain nucleotide sequence: coding sequence (variable region in bold)

(SEQ ID NO: 551)
ATGAGGCTCCCTGCTCAGCTCCTGGGGCTGCTAATGCTCTGGATACCT

GAACTTGCTGCAGACATTGTGATGACCCAGTCTCCTGTCTCTCTGTCC

GTCACCCTCGGACAGCCGGCCTCCATGTCCTGCAAGTCCAGTCAGACT

GTCCGACAGAGTGATGGCAAGACTTTCTTATATTGGTATCGACAGAAG

GCAGGCCAGTCTCCACAACTGTTAATATATGAGGGTTCGAATCGATTC

TCTGGAGTGTCAGATAGGATCTCTGGCAGCGGGTCGGGGACAGATTTC

ACACTGAGAATCAGTCGAGTGGAGGCTGAGGATGTTGGCGTTTATTTC

TGCCTGCAAACTAAAGACTTCCCCCTCACTTTTGGCGGAGGGACCAGG

GTGGATATCAAACGTACGGTGGCTGCACCATCTGTCTTCATCTTCCCG

CCATCTGATGAGCAGTTGAAATCTGGAACTGCCTCTGTTGTGTGCCTG

CTGAATAACTTCTATCCCAGAGAGGCCAAAGTACAGTGGAAGGTGGAT

AACGCCCTCCAATCGGGTAACTCCCAGGAGAGTGTCACAGAGCAGGAC

AGCAAGGACAGCACCTACAGCCTCAGCAGCACCCTGACGCTGAGCAAA

GCAGACTACGAGAAACACAAAGTCTACGCCTGCGAAGTCACCCATCAG

GGCCTGAGCTCGCCCGTCACAAAGAGCTTCAACAGGGGAGAGTGTTAG

6808_B09 (PGT-156) light chain variable region nucleotide sequence:

(SEQ ID NO: 552)
GACATTGTGATGACCCAGTCTCCTGTCTCTCTGTCCGTCACCCTCGGA

CAGCCGGCCTCCATGTCCTGCAAGTCCAGTCAGACTGTCCGACAGAGT

GATGGCAAGACTTTCTTATATTGGTATCGACAGAAGGCAGGCCAGTCT

CCACAACTGTTAATATATGAGGGTTCGAATCGATTCTCTGGAGTGTCA

GATAGGATCTCTGGCAGCGGGTCGGGGACAGATTTCACACTGAGAATC

AGTCGAGTGGAGGCTGAGGATGTTGGCGTTTATTTCTGCCTGCAAACT

AAAGACTTCCCCCTCACTTTTGGCGGAGGGACCAGGGTGGATATCAAA

6808_B09 (PGT-156) light chain amino acid sequence: expressed protein with leader sequence in italics and variable region in bold.

(SEQ ID NO: 553)
*MRLPAQLLGLLMLWIPELAA*DIVMTQSPVSLSVTLGQPASMSCKSSQT

VRQSDGKTFLYWYRQKAGQSPQLLIYEGSNRFSGVSDRISGSGSGTDF

TLRISRVEAEDVGVYFCLQTKDFPLTFGGGTRVDIKRTVAAPSVFIFP

PSDEQLKSGTASVVCLLNNFYPREAKVQWKVDNALQSGNSQESVTEQD

SKDSTYSLSSTLTLSKADYEKHKVYACEVTHQGLSSPVTKSFNRGEC

6808_B09 (PGT-156) light chain variable region amino acid sequence: (Kabat CDRs underlined, Chothia CDRs in bold italics)

(SEQ ID NO: 554)
DIVMTQSPVSLSVTLGQPASMSC<u>*KSSQTVRQSDGKTFLY*</u>WYRQKAGQSPQ

LLI<u>*EGSNRFS*</u>GVSDRISGSGSGTDFTLRISRVEAEDVGVYFC

<u>*LQTKDFPLT*</u>FGGGTRVDIK

6808_B09 (PGT-156) light chain Kabat CDRs:

```
CDR 1:
                                    (SEQ ID NO: 555)
KSSQTVRQSDGKTFLY

CDR 2:
                                    (SEQ ID NO: 556)
EGSNRFS

CDR 3:
                                    (SEQ ID NO: 543)
LQTKDFPLT
```

6808B09 (PGT-156) light chain Chothia CDRs:

CDR 1:
(SEQ ID NO: 555)
KSSQTVRQSDGKTFLY

CDR 2:
(SEQ ID NO: 556)
EGSNRFS

CDR 3:
(SEQ ID NO: 543)
LQTKDFPLT

6892_C23 (PGT-157) gamma heavy chain nucleotide sequence: coding sequence (leader sequence in italics, variable region in bold)

(SEQ ID NO: 557)
*ATGGAATTGGGGCTGAGCTGGGTTTTCCTCGTCGCTCTCCTAAGAGGT*

*GTCCACTGT*GAAGTGCATCTGGTGGAGTCGGGGGGAGGCGTGGTCCAA

CCTGGAAAGTCCCTCAGACTCTCCTGTGTAACTTCTGGCTTCATCTTC

AAACAATATCCTATGTATTGGATCCGCCAGGCTCCAGGCAAGGGGCTG

GAGTGGGTGGCCGCCATCTCCGCTGATGCCTGGCATGTGGACTACGCA

GGCTCCGTGCGGGGCCGATTTACCGTCTCCAGAGACAACTCCAAGAAT

TCTCTATATTTAGACATGAACAGTCTGACAGTTGAAGACACGGCTATA

TATTTCTGTGCGAAAGATGGGGAAGAACACGAAGTACCACAGTTGCAC

TCCTGGAGCGGACGAAATTTATATCACTACACTGGTGTGGACATCTGG

GGCCCAGGGACCACGGTCACCGTCTCGAGCGCCTCCACCAAGGGCCCA

TCGGTCTTCCCCCTGGCACCCTCCTCCAAGAGCACCTCTGGGGGCACA

GCGGCCCTGGGCTGCCTGGTCAAGGACTACTTCCCCGAACCGGTGACG

GTGTCGTGGAACTCAGGCGCCCTGACCAGCGGCGTGCACACCTTCCCG

GCTGTCCTACAGTCCTCAGGACTCTACTCCCTCAGCAGCGTGGTGACC

GTGCCCTCCAGCAGCTTGGGCACCCAGACCTACATCTGCAACGTGAAT

CACAAGCCCAGCAACACCAAGGTGGACAAGAGAGTTGAGCCCAAATCT

TGTGACAAAACTCACACATGCCCACCGTGCCCAGCACCTGAACTCCTG

GGGGGACCGTCAGTCTTCCTCTTCCCCCCAAAACCCAAGGACACCCTC

ATGATCTCCCGGACCCCTGAGGTCACATGCGTGGTGGTGGACGTGAGC

CACGAAGACCCTGAGGTCAAGTTCAACTGGTACGTGGACGGCGTGGAG

GTGCATAATGCCAAGACAAAGCCGCGGGAGGAGCAGTACAACAGCACG

TACCGTGTGGTCAGCGTCCTCACCGTCCTGCACCAGGACTGGCTGAAT

GGCAAGGAGTACAAGTGCAAGGTCTCCAACAAAGCCCTCCCAGCCCCC

ATCGAGAAACCATCTCCAAAGCCAAAGGGCAGCCCCGAGAACCACAG

GTGTACACCCTGCCCCCATCCCGGGAGGAGATGACCAAGAACCAGGTC

AGCCTGACCTGCCTGGTCAAAGGCTTCTATCCCAGCGACATCGCCGTG

GAGTGGGAGAGCAATGGGCAGCCGGAGAACAACTACAAGACCACGCCT

CCCGTGCTGGACTCCGACGGCTCCTTCTTCCTCTATAGCAAGCTCACC

GTGGACAAGAGCAGGTGGCAGCAGGGGAACGTCTTCTCATGCTCCGTG

ATGCATGAGGCTCTGCACAACCACTACACGCAGAAGAGCCTCTCCCTG

TCTCCGGGTAAATGA

6892_C23 (PGT-157) gamma heavy chain variable region nucleotide sequence:

(SEQ ID NO: 558)
GAAGTGCATCTGGTGGAGTCGGGGGGAGGCGTGGTCCAACCTGGAAAG

TCCCTCAGACTCTCCTGTGTAACTTCTGGCTTCATCTTCAAACAATAT

CCTATGTATTGGATCCGCCAGGCTCCAGGCAAGGGGCTGGAGTGGGTG

GCCGCCATCTCCGCTGATGCCTGGCATGTGGACTACGCAGGCTCCGTG

CGGGGCCGATTTACCGTCTCCAGAGACAACTCCAAGAATTCTCTATAT

TTAGACATGAACAGTCTGACAGTTGAAGACACGGCTATATATTTCTGT

GCGAAAGATGGGGAAGAACACGAAGTACCACAGTTGCACTCCTGGAGC

GGACGAAATTTATATCACTACACTGGTGTGGACATCTGGGGCCCAGGG

ACCACGGTCACCGTCTCGAGC

6892_C23 (PGT-157) gamma heavy chain amino acid sequence: expressed protein with leader sequence in italics and variable region in bold.

(SEQ ID NO: 559)
*MELGLSWVFLVALLRGVHC*EVHLVESGGGVVQPGKSLRLSCVTSGFIF

KQYPMYWIRQAPGKGLEWVAAISADAWHVDYAGSVRGRFTVSRDNSKN

SLYLDMNSLTVEDTAIYFCAKDGEEHEVPQLHSWSGRNLYHYTGVDIW

GPGTTVTVSSASTKGPSVFPLAPSSKSTSGGTAALGCLVKDYFPEPVT

VSWNSGALTSGVHTFPAVLQSSGLYSLSSVVTVPSSSLGTQTYICNVN

HKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYNST

YRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSL

SPGK

6892_C23 (PGT-157) gamma heavy chain variable region amino acid sequence: (Kabat CDRs underlined, Chothia CDRs in bold italics)

(SEQ ID NO: 560)
EVHLVESGGGVVQPGKSLRLSCVTS*GFIFKQ*YPMYWIRQAPGKGLEW

VAAISADAWHVDYAGSVRGRFTVSRDNSKNSLYLDMNSLTVEDTAIY

FCAK*DGEEHEVPQLHSWSGRNLYHYTGVDI*WGPGTTVTVSS

6892_C23 (PGT-157) gamma heavy chain Kabat CDRs:

CDR 1:
(SEQ ID NO: 548)
QYPMY

CDR 2:
(SEQ ID NO: 534)
AISADAWHVDYAGSVRG

CDR 3:
(SEQ ID NO: 561)
DGEEHEVPQLHSWSGRNLYHYTGVDI

6892_C23 (PGT-157) gamma heavy chain Chothia CDRs:

(SEQ ID NO: 562)
CDR 1: GFIFKQ (SEQ ID NO: 521)
CDR 2: AISADAWHVD (SEQ ID NO: 561)
CDR 3: DGEEHEVPQLHSWSGRNLYHYTGVDI

6892_C23 (PGT-157) light chain nucleotide sequence: coding sequence (variable region in bold)

(SEQ ID NO: 563)
ATGAGGCTCCCTGCTCAGCTCCTGGGGCTGCTAATGCTCTGGATACCTGA
ACTTACTGCAGACATTGTGATGACCCAGACTCCTGTCTCTCTGTCCGT
CACCCTCGGACAGCCGGCCTCCATGTCCTGTAAGTCCAGTCAGAG
CCTCCGACAAAGTGATGGCAAGACTTTCTTGTATTGGTATCGACA
GAAGGCAGGCCAGTCTCCACAACTCCTAATATCTGAGGCTTCGAA
TCGATTCTCTGGAGTGTCAGATAGGTTCTCTGGCAGCGGTTCAGG
GACAGACTTCACACTGAAAATCAGTCGGGTGGAGGCTGAGGATGT
TGGCATTTATTTCTGCATGCAAACTAAAGACTTCCCCCTCACTTTT
GGCGGAGGGACCAAGGTGGATCTCAAACGTACGGTGGCTGCACCAT
CTGTCTTCATCTTCCCGCCATCTGATGAGCAGTTGAAATCTGGAACTGC
CTCTGTTGTGTGCCTGCTGAATAACTTCTATCCCAGAGAGGCCAAAGT
ACAGTGGAAGGTGGATAACGCCCTCCAATCGGGTAACTCCCAGGAGA
GTGTCACAGAGCAGGACAGCAAGGACAGCACCTACAGCCTCAGCAGC
ACCCTGACGCTGAGCAAAGCAGACTACGAGAAACACAAAGTCTACGC
CTGCGAAGTCACCCATCAGGGCCTGAGCTCGCCCGTCACAAAGAGCTT
CAACAGGGGAGAGTGTTAG

6892_C23 (PGT-157) light chain variable region nucleotide sequence:

(SEQ ID NO: 564)
GACATTGTGATGACCCAGACTCCTGTCTCTCTGTCCGTCACCCTCG
GACAGCCGGCCTCCATGTCCTGTAAGTCCAGTCAGAGCCTCCGAC
AAAGTGATGGCAAGACTTTCTTGTATTGGTATCGACAGAAGGCAG
GCCAGTCTCCACAACTCCTAATATCTGAGGCTTCGAATCGATTCTC
TGGAGTGTCAGATAGGTTCTCTGGCAGCGGTTCAGGGACAGACTT
CACACTGAAAATCAGTCGGGTGGAGGCTGAGGATGTTGGCATTTA
TTTCTGCATGCAAACTAAAGACTTCCCCCTCACTTTTGGCGGAGGG
ACCAAGGTGGATCTCAAA

6892_C23 (PGT-157) light chain amino acid sequence: expressed protein with leader sequence in italics and variable region in bold.

(SEQ ID NO: 565)
*MRLPAQLLGLLMLWIPELTA*DIVMTQTPVSLSVTLGQPASMSCKSSQSLR
QSDGKTFLYWYRQKAGQSPQLLISEASNRFSGVSDRFSGSGSGTDFTL
KISRVEAEDVGIYFCMQTKDFPLTFGGGTKVDLKRTVAAPSVFIFPPSD
EQLKSGTASVVCLLNNFYPREAKVQWKVDNALQSGNSQESVTEQDSKDS
TYSLSSTLTLSKADYEKHKVYACEVTHQGLSSPVTKSFNRGEC

6892_C23 (PGT-157) light chain variable region amino acid sequence: (Kabat CDRs underlined, Chothia CDRs in bold italics)

(SEQ ID NO: 566)
DIVMTQTPVSLSVTLGQPASMSC*KSSQSLRQSDGKTFLY*WYRQKAGQ
SPQLLIS*EASNRFS*GVSDRFSGSGSGTDFTLKISRVEAEDVGIYFC
*MQTKDFPLT*FGGGTKVDLK

6892_C23 (PGT-157) light chain Kabat CDRs:

(SEQ ID NO: 567)
CDR 1: KSSQSLRQSDGKTFLY (SEQ ID NO: 568)
CDR 2: EASNRFS (SEQ ID NO: 569)
CDR 3: MQTKDFPLT

6892_C23 (PGT-157) light chain Chothia CDRs:

(SEQ ID NO: 567)
CDR 1: KSSQSLRQSDGKTFLY (SEQ ID NO: 568)
CDR 2: EASNRFS (SEQ ID NO: 569)
CDR 3: MQTKDFPLT

6881_N05 (PGT-158) gamma heavy chain nucleotide sequence: coding sequence (variable region in bold)

(SEQ ID NO: 570)
ATGGAATTGGGGCTGAGCTGGGTTTTCCTCGTCGCTCTCCTAAGAGGTGT
CCACTGTGAGGTGCGTCTGATGGAGTCGGGGGGAGGCGTGGTCCAG
CCTGGGAAGTCCCTCAGACTCTCCTGTGTAACCTCTGGCTTCATCT
TCAAAAAATATCCTATGTACTGGATCCGCCAGGCTCCAGGCAAGG
GGCTGGAGTGGGTGGCCGCCATCTCCGCTGATGCCTGGCATGTGG
ACTACCCAGGCTCCGTGCGGGGCCGATTTACCGTCTCAAGAGACA
ACTCCAAGAATTCTCTATATTTAGACATGAATAGTCTGACAGTAGA
AGACACGGCTATATATTTTTGTGCGAAAGATGGGGAGGAACACGA
AGTCCCACAACTGCACTCCTGGAGCGGACGAAATTTATATCACTA
CACTGGTGTAGACGTCTGGGGCCCAGGGACCACGGTCACCGTCTC
GAGCGCCTCCACCAAGGGCCCATCGGTCTTCCCCCTGGCACCCTCCTC
CAAGAGCACCTCTGGGGGCACAGCGGCCCTGGGCTGCCTGGTCAAGG
ACTACTTCCCCGAACCGGTGACGGTGTCGTGGAACTCAGGCGCCCTGA

-continued
CCAGCGGCGTGCACACCTTCCCGGCTGTCCTACAGTCCTCAGGACTCT

ACTCCCTCAGCAGCGTGGTGACCGTGCCCTCCAGCAGCTTGGGCACCC

AGACCTACATCTGCAACGTGAATCACAAGCCCAGCAACACCAAGGTG

GACAAGAGAGTTGAGCCCAAATCTTGTGACAAAACTCACACATGCCCA

CCGTGCCCAGCACCTGAACTCCTGGGGGGACCGTCAGTCTTCCTCTTCC

CCCCAAAACCCAAGGACACCCTCATGATCTCCCGGACCCCTGAGGTCA

CATGCGTGGTGGTGGACGTGAGCCACGAAGACCCTGAGGTCAAGTTCA

ACTGGTACGTGGACGGCGTGGAGGTGCATAATGCCAAGACAAAGCCG

CGGGAGGAGCAGTACAACAGCACGTACCGTGTGGTCAGCGTCCTCACC

GTCCTGCACCAGGACTGGCTGAATGGCAAGGAGTACAAGTGCAAGGT

CTCCAACAAAGCCCTCCCAGCCCCCATCGAGAAAACCATCTCCAAAGC

CAAAGGGCAGCCCCGAGAACCACAGGTGTACACCCTGCCCCCATCCCG

GGAGGAGATGACCAAGAACCAGGTCAGCCTGACCTGCCTGGTCAAAG

GCTTCTATCCCAGCGACATCGCCGTGGAGTGGGAGAGCAATGGGCAGC

CGGAGAACAACTACAAGACCACGCCTCCCGTGCTGGACTCCGACGGCT

CCTTCTTCCTCTATAGCAAGCTCACCGTGGACAAGAGCAGGTGGCAGC

AGGGGAACGTCTTCTCATGCTCCGTGATGCATGAGGCTCTGCACAACC

ACTACACGCAGAAGAGCCTCTCCCTGTCTCCGGGTAAATGA

6881_N05 (PGT-158) gamma heavy chain variable region nucleotide sequence:

(SEQ ID NO: 571)
GAGGTGCGTCTGATGGAGTCGGGGGGAGGCGTGGTCCAGCCTGG

GAAGTCCCTCAGACTCTCCTGTGTAACCTCTGGCTTCATCTTCAAA

AAATATCCTATGTACTGGATCCGCCAGGCTCCAGGCAAGGGGCTG

GAGTGGGTGGCCGCCATCTCCGCTGATGCCTGGCATGTGGACTAC

CCAGGCTCCGTGCGGGCCGATTTACCGTCTCAAGAGACAACTCC

AAGAATTCTCTATATTTAGACATGAATAGTCTGACAGTAGAAGACA

CGGCTATATATTTTGTGCGAAAGATGGGGAGGAACACGAAGTCC

CACAACTGCACTCCTGGAGCGGACGAAATTTATATCACTACACTG

GTGTAGACGTCTGGGGCCCAGGGACCACGGTCACCGTCTCGAGC

6881_N05 (PGT-158) gamma heavy chain amino acid sequence: expressed protein with leader sequence in italics and variable region in bold.

(SEQ ID NO: 572)
*MELGLSWVELVALLRGVHC*EVRLMESGGGVVQPGKSLRLSCVTSGFIFK

KYPMYWIRQAPGKGLEWVAAISADAWHVDYPGSVRGRFTVSRDNSK

NSLYLDMNSLTVEDTAIYFCAKDGEEHEVPQLHSWSGRNLYHYTGVD

VWGPGTTVTVSSASTKGPSVFPLAPSSKSTSGGTAALGCLVKDYFPEPVT

VSWNSGALTSGVHTFPAVLQSSGLYSLSSVVTVPSSSLGTQTYICNVNHK

PSNTKVDKRVEPKSCDKTHTCPPCPAPELLGGPSVFLFPPKPKDTLMISR

TPEVTCVVVDVSHEDPEVKFNWYVDGVEVHNAKTKPREEQYNSTYRVVSV

-continued
LTVLHQDWLNGKEYKCKVSNKALPAPIEKTISKAKGQPREPQVYTLPPSR

EEMTKNQVSLTCLVKGFYPSDIAVEWESNGQPENNYKTTPPVLDSDGSFF

LYSKLTVDKSRWQQGNVFSCSVMHEALHNHYTQKSLSLSPGK

6881_N05 (PGT-158) gamma heavy chain variable region amino acid sequence: (Kabat CDRs underlined, Chothia CDRs in bold italics)

(SEQ ID NO: 573)
EVRLMESGGGVVQPGKSLRLSCVTS*GFIFKK*<u>YPMY</u>WIRQAPGKGLEW

VA*AISADAWHVD*<u>YPGSVG</u>RFTVSRDNSKNSLYLDMNSLTVEDTAIY

FCAK<u>*DGEEHEVPQLHSWSGRNLYHYTGVDV*</u>WGPGTTVTVSS

6881_N05 (PGT-158) gamma heavy chain Kabat CDRs:

(SEQ ID NO: 475)
CDR 1: KYPMY (SEQ ID NO: 549)
CDR 2: AISADAWHVDYPGSVRG (SEQ ID NO: 574)
CDR 3: DGEEHEVPQLHSWSGRNLYHYTGVDV

6881_N05 (PGT-158) gamma heavy chain Chothia CDRs:

(SEQ ID NO: 575)
CDR 1: GFIFKK (SEQ ID NO: 521)
CDR 2: AISADAWHVD (SEQ ID NO: 574)
CDR 3: DGEEHEVPQLHSWSGRNLYHYTGVDV

6881_N05 (PGT-158) light chain nucleotide sequence: coding sequence (variable region in bold)

(SEQ ID NO: 576)
*ATGAGGCTCCCTGCTCAGCTCCTGGGGCTGCTAATGCTCTGGATACCTGA*

*AGT*GACTGCAGACATTGTGATGACCCAGACTCCTGTCTCTGTGTCCG

TCACCCTCGGACAGCCGGCCTCCATGTCCTGCAAGTCCAGTCAGA

GCGTCCGACAAAGTGATGGCAAGACTTTTTTATATTGGTATCGACA

GAAGGCAGGCCAGTCTCCACAACTCTTAATATATGAGGCTTCGAA

GCGATTCTCTGGAGTGTCAGATAGGTTCTCTGGCAGCGGGTCAGG

GACAGACTTCACACTGAAAATCAGTCGGGTGGGGCTGAGGATGT

TGGCGTTTATTTCTGCATGCAAACTAAAGACTTCCCCCTTACTTTT

GGCGGAGGGACCAAGGTGGATCTCAAACGTACGGTGGCTGCACCAT

CTGTCTTCATCTTCCCGCCATCTGATGAGCAGTTGAAATCTGGAACTGC

CTCTGTTGTGTGCCTGCTGAATAACTTCTATCCCAGAGAGGCCAAAGT

ACAGTGGAAGGTGGATAACGCCCTCCAATCGGGTAACTCCCAGGAGA

GTGTCACAGAGCAGGACAGCAAGGACAGCACCTACAGCCTCAGCAGC

ACCCTGACGCTGAGCAAAGCAGACTACGAGAAACACAAAGTCTACGC

6881_N05 (PGT-158) light chain variable region nucleotide sequence:

(SEQ ID NO: 577)
GACATTGTGATGACCCAGACTCCTGTCTCTGTGTCCGTCACCCTCG

GACAGCCGGCCTCCATGTCCTGCAAGTCCAGTCAGAGCGTCCGAC

AAAGTGATGGCAAGACTTTTTTATATTGGTATCGACAGAAGGCAG

GCCAGTCTCCACAACTCTTAATATATGAGGCTTCGAAGCGATTCTC

TGGAGTGTCAGATAGGTTCTCTGGCAGCGGGTCAGGGACAGACTT

CACACTGAAAATCAGTCGGGTGGGGCTGAGGATGTTGGCGTTTA

TTTCTGCATGCAAACTAAAGACTTCCCCCTTACTTTTGGCGGAGGG

ACCAAGGTGGATCTCAAA

6881_N05 (PGT-158) light chain amino acid sequence: expressed protein with leader sequence in italics and variable region in bold.

(SEQ ID NO: 578)
*MRLPAQLLGLLMLWIPEVTA*DIVMTQTPVSVSVTLGQPASMSCKSSQSVR

QSDGKTFLYWYRQKAGQSPQLLIYEASKRFSGVSDRFSGSGSGTDFTL

KISRVGAEDVGVYFCMQTKDFPLTFGGGTKVDLKRTVAAPSVFIFPPS

DEQLKSGTASVVCLLNNFYPREAKVQWKVDNALQSGNSQESVTEQDSKD

STYSLSSTLTLSKADYEKHKVYACEVTHQGLSSPVTKSFNRGEC

6881_N05 (PGT-158) light chain variable region amino acid sequence: (Kabat CDRs underlined, Chothia CDRs in bold italics)

(SEQ ID NO: 579)
DIVMTQTPVSVSVTLGQPASMSC*KSSQSVRQSDGKTFLY*WYRQKAGQ

SPQLLIY*EASKRFS*GVSDRFSGSGSGTDFTLKISRVGAEDVGVYFC

*MQTKDFPLT*FGGGTKVDLK

6881_N05 (PGT-158) light chain Kabat CDRs:

```
                            (SEQ ID NO: 541)
CDR 1: KSSQSVRQSDGKTFLY (SEQ ID NO: 580)
CDR 2: EASKRFS (SEQ ID NO: 569)
CDR 3: MQTKDFPLT
```

6881_N05 (PGT-158) light chain Chothia CDRs:

```
                            (SEQ ID NO: 541)
CDR 1: KSSQSVRQSDGKTFLY (SEQ ID NO: 580)
CDR 2: EASKRFS (SEQ ID NO: 569)
CDR 3: MQTKDFPLT
```

The 6831_A21 (PGT-151) antibody includes a heavy chain variable region (SEQ ID NO: 474), encoded by the nucleic acid sequence shown in SEQ ID NO: 472, and a light chain variable region (SEQ ID NO: 483) encoded by the nucleic acid sequence shown in SEQ ID NO: 481.

The heavy chain CDRs of the 6831_A21 (PGT-151) antibody have the following sequences per Kabat definition: KYPMY (SEQ ID NO: 475), AISGDAWHVVYSNSVQG (SEQ ID NO: 476), and MFQESGPPRLDRWSGRNYYYYSGMDV (SEQ ID NO: 477). The light chain CDRs of the 6831_A21 (PGT-151) antibody have the following sequences per Kabat definition: KSSESLRQSNGKTSLY (SEQ ID NO: 484), EVSNRFS (SEQ ID NO: 485), and MQSKDFPLT (SEQ ID NO: 486).

The heavy chain CDRs of the 6831_A21 (PGT-151) antibody have the following sequences per Chothia definition: DFPFSK (SEQ ID NO: 478), AISGDAWHVV (SEQ ID NO: 479), and MFQESGPPRLDRWSGRNYYYYSGMDV (SEQ ID NO: 477). The light chain CDRs of the 6831_A21 (PGT-151) antibody have the following sequences per Chothia definition: KSSESLRQSNGKTSLY (SEQ ID NO: 484), EVSNRFS (SEQ ID NO: 485), and MQSKDFPLT (SEQ ID NO: 486).

The 6889_I17 (PGT-152) antibody includes a heavy chain variable region (SEQ ID NO: 490), encoded by the nucleic acid sequence shown in SEQ ID NO: 488, and a light chain variable region (SEQ ID NO: 497) encoded by the nucleic acid sequence shown in SEQ ID NO: 495.

The heavy chain CDRs of the 6889_I17 (PGT-152) antibody have the following sequences per Kabat definition: KYPMY (SEQ ID NO: 475), AISADAWHVVYSGSVQG (SEQ ID NO: 491), and MFQESGPPRFDSWSGRNYYYYSGMDV (SEQ ID NO: 492). The light chain CDRs of the 6889_I17 (PGT-152) antibody have the following sequences per Kabat definition: KSSQSLRQSNGKTSLY (SEQ ID NO: 498), EVSNRFS (SEQ ID NO: 485), and MQSKDFPLT (SEQ ID NO: 486).

The heavy chain CDRs of the 6889_I17 (PGT-152) antibody have the following sequences per Chothia definition: DFPFSK (SEQ ID NO: 478), AISADAWHVV (SEQ ID NO: 493), and MFQESGPPRFDSWSGRNYYYYSGMDV (SEQ ID NO: 492). The light chain CDRs of the 6889_I17 (PGT-152) antibody have the following sequences per Chothia definition: KSSQSLRQSNGKTSLY (SEQ ID NO: 498), EVSNRFS (SEQ ID NO: 485), and MQSKDFPLT (SEQ ID NO: 486).

The 6891_F06 (PGT-153) antibody includes a heavy chain variable region (SEQ ID NO: 502), encoded by the nucleic acid sequence shown in SEQ ID NO: 500, and a light chain variable region (SEQ ID NO: 511) encoded by the nucleic acid sequence shown in SEQ ID NO: 509.

The heavy chain CDRs of the 6891_F06 (PGT-153) antibody have the following sequences per Kabat definition: KRHMH (SEQ ID NO: 503), VISSDAIHVDYASSVRG (SEQ ID NO: 504), and DRDGYGPPQIQTWSGRYL-HLYSGIDA (SEQ ID NO: 505). The light chain CDRs of the 6891_F06 (PGT-153) antibody have the following sequences per Kabat definition: KSSQSLRQSNGKTYLY (SEQ ID NO: 512), EVSIRFS (SEQ ID NO: 513), and MQSKDFPLT (SEQ ID NO: 486).

The heavy chain CDRs of the 6891_F06 (PGT-153) antibody have the following sequences per Chothia definition: NFLFNK (SEQ ID NO: 506), VISSDAIHVD (SEQ ID NO: 507), and DRDGYGPPQIQTWSGRYLHLYSGIDA (SEQ ID NO: 505). The light chain CDRs of the 6891_F06 (PGT-153) antibody have the following sequences per Chothia definition: KSSQSLRQSNGKTYLY (SEQ ID NO: 512), EVSIRFS (SEQ ID NO: 513), and MQSKDFPLT (SEQ ID NO: 486).

The 6843_G20 (PGT-154) antibody includes a heavy chain variable region (SEQ ID NO: 517), encoded by the nucleic acid sequence shown in SEQ ID NO: 515, and a light chain variable region (SEQ ID NO: 525) encoded by the nucleic acid sequence shown in SEQ ID NO: 523.

The heavy chain CDRs of the 6843_G20 (PGT-154) antibody have the following sequences per Kabat definition: KYPMY (SEQ ID NO: 475), AISADAWHVDYAASVKD (SEQ ID NO: 518), and NIEEFSVPQFDSWSGRSYYHY-FGMDV (SEQ ID NO: 519). The light chain CDRs of the 6843_G20 (PGT-154) antibody have the following sequences per Kabat definition: SSSESLGRGDGRTYLH (SEQ ID NO: 526), EVSTRFS (SEQ ID NO: 527), and MQSRDFPIT (SEQ ID NO: 528).

The heavy chain CDRs of the 6843_G20 (PGT-154) antibody have the following sequences per Chothia definition: NFIFNK (SEQ ID NO: 520), AISADAWHVD (SEQ ID NO: 521), and NIEEFSVPQFDSWSGRSYYHYFG-MDV (SEQ ID NO: 519). The light chain CDRs of the 6843_G20 (PGT-154) antibody have the following sequences per Chothia definition: SSSESLGRGDGRTYLH (SEQ ID NO: 526), EVSTRFS (SEQ ID NO: 527), and MQSRDFPIT (SEQ ID NO: 528).

The 6892_D19 (PGT-155) antibody includes a heavy chain variable region (SEQ ID NO: 532), encoded by the nucleic acid sequence shown in SEQ ID NO: 530, and a light chain variable region (SEQ ID NO: 540) encoded by the nucleic acid sequence shown in SEQ ID NO: 538.

The heavy chain CDRs of the 6892_D19 (PGT-155) antibody have the following sequences per Kabat definition: EYPMY (SEQ ID NO: 533), AISADAWHVDYAGSVRG (SEQ ID NO: 534), and DGEEHKVPQLHSWSGRNLY-HYTGFDV (SEQ ID NO: 535). The light chain CDRs of the 6892_D19 (PGT-155) antibody have the following sequences per Kabat definition: KSSQSVRQSDGKTFLY (SEQ ID NO: 541), EGSSRFS (SEQ ID NO: 542), and LQTKDFPLT (SEQ ID NO: 543).

The heavy chain CDRs of the 6892_D19 (PGT-155) antibody have the following sequences per Chothia definition: GFIFNE (SEQ ID NO: 536), AISADAWHVD (SEQ ID NO: 521), and DGEEHKVPQLHSWSGRNLYHYT-GFDV (SEQ ID NO: 535). The light chain CDRs of the 6892_D19 (PGT-155) antibody have the following sequences per Chothia definition: KSSQSVRQSDGKTFLY (SEQ ID NO: 541), EGSSRFS (SEQ ID NO: 542), and LQTKDFPLT (SEQ ID NO: 543).

The 6808_B09 (PGT-156) antibody includes a heavy chain variable region (SEQ ID NO: 547), encoded by the nucleic acid sequence shown in SEQ ID NO: 545, and a light chain variable region (SEQ ID NO: 554) encoded by the nucleic acid sequence shown in SEQ ID NO: 552.

The heavy chain CDRs of the 6808_B09 (PGT-156) antibody have the following sequences per Kabat definition: QYPMY (SEQ ID NO: 548), AISADAWHVDYPGSVRG (SEQ ID NO: 549), and DGEEHKVPQLHSWSGRNLY-HYTGFDV (SEQ ID NO: 535). The light chain CDRs of the 6808_B09 (PGT-156) antibody have the following sequences per Kabat definition: KSSQTVRQSDGKTFLY (SEQ ID NO: 555), EGSNRFS (SEQ ID NO: 556), and LQTKDFPLT (SEQ ID NO: 543).

The heavy chain CDRs of the 6808_B09 (PGT-156) antibody have the following sequences per Chothia definition: GFIFNQ (SEQ ID NO: 550), AISADAWHVD (SEQ ID NO: 521), and DGEEHKVPQLHSWSGRNLYHYT-GFDV (SEQ ID NO: 535). The light chain CDRs of the 6808_B09 (PGT-156) antibody have the following sequences per Chothia definition: KSSQTVRQSDGKTFLY (SEQ ID NO: 555), EGSNRFS (SEQ ID NO: 556), and LQTKDFPLT (SEQ ID NO: 543).

The 6892_C23 (PGT-157) antibody includes a heavy chain variable region (SEQ ID NO: 560), encoded by the nucleic acid sequence shown in SEQ ID NO: 558, and a light chain variable region (SEQ ID NO: 566) encoded by the nucleic acid sequence shown in SEQ ID NO: 564.

The heavy chain CDRs of the 6892_C23 (PGT-157) antibody have the following sequences per Kabat definition: QYPMY (SEQ ID NO: 548), AISADAWHVDYAGSVRG (SEQ ID NO: 534), and DGEEHEVPQLHSWSGRNLY-HYTGVDI (SEQ ID NO: 561). The light chain CDRs of the 6892_C23 (PGT-157) antibody have the following sequences per Kabat definition: KSSQSLRQSDGKTFLY (SEQ ID NO: 567), EASNRFS (SEQ ID NO: 568), and MQTKDFPLT (SEQ ID NO: 569).

The heavy chain CDRs of the 6892_C23 (PGT-157) antibody have the following sequences per Chothia definition: GFIFKQ (SEQ ID NO: 562), AISADAWHVD (SEQ ID NO: 521), and DGEEHEVPQLHSWSGRNLYHYT-GVDI (SEQ ID NO: 561). The light chain CDRs of the 6892_C23 (PGT-157) antibody have the following sequences per Chothia definition: KSSQSLRQSDGKTFLY (SEQ ID NO: 567), EASNRFS (SEQ ID NO: 568), and MQTKDFPLT (SEQ ID NO: 569).

The 6881_N05 (PGT-158) antibody includes a heavy chain variable region (SEQ ID NO: 573), encoded by the nucleic acid sequence shown in SEQ ID NO: 571, and a light chain variable region (SEQ ID NO: 579) encoded by the nucleic acid sequence shown in SEQ ID NO: 577.

The heavy chain CDRs of the 6881_N05 (PGT-158) antibody have the following sequences per Kabat definition: KYPMY (SEQ ID NO: 475), AISADAWHVDYPGSVRG (SEQ ID NO: 549), and DGEEHEVPQLHSWSGRNLY-HYTGVDV (SEQ ID NO: 574). The light chain CDRs of the 6881_N05 (PGT-158) antibody have the following sequences per Kabat definition: KSSQSVRQSDGKTFLY (SEQ ID NO: 541), EASKRFS (SEQ ID NO: 580), and MQTKDFPLT (SEQ ID NO: 569).

The heavy chain CDRs of the 6881_N05 (PGT-158) antibody have the following sequences per Chothia definition: GFIFKK (SEQ ID NO: 575), AISADAWHVD (SEQ ID NO: 521), and DGEEHEVPQLHSWSGRNLYHYT-GVDV (SEQ ID NO: 574). The light chain CDRs of the 6881_N05 (PGT-158) antibody have the following sequences per Chothia definition: KSSQSVRQSDGKTFLY (SEQ ID NO: 541), EASKRFS (SEQ ID NO: 580), and MQTKDFPLT (SEQ ID NO: 569).

In one aspect, an antibody according to the invention contains a heavy chain having the amino acid sequence of SEQ ID NOs: 12, 16, 20, 24, 28, 139, 47, 53, 59, 65, 62, 153, 165, 181, 197, 213, 229, 246, 275, 291, 297, 306, 318, 333, 346, 362, 400, 404, 419, 434, 443, 453, 462, 473, 489, 501, 516, 531, 546, 559, or 572, and a light chain having the amino acid sequence of SEQ ID NOs: 14, 18, 22, 26, 30, 142, 50, 56, 148, 158, 174, 190, 206, 222, 238, 255, 284, 301, 312, 329, 392, 355, 396, 385, 413, 428, 439, 448, 583, 469, 482, 496, 510, 524, 539, 553, 565, or 578. Alternatively, an antibody according to the invention contains a heavy chain variable region having the amino acid sequence of SEQ ID NOs: 31, 33, 35, 37, 39, 140, 48, 54, 60, 79, 156, 168, 184, 200, 216, 232, 149, 276, 292, 298, 307, 319, 334, 347, 363, 401, 405, 420, 435, 444, 454, 463, 474, 490, 502, 517, 532, 547, 560, or 573, and a light chain variable region having the amino acid sequence of SEQ ID NOs: 32, 34, 36, 38, 40, 96, 51, 57, 149, 161, 177, 193, 209, 225, 242, 258, 285, 302, 313, 330, 393, 356, 397, 386, 414, 429, 440, 449, 584, 470, 483, 497, 511, 525, 540, 554, 566, or 579.

In another aspect, an antibody according to the invention contains a heavy chain having the amino acid sequence encoded by the nucleic acid sequence of SEQ ID NOs: 11, 15, 19, 23, 27, 138, 46, 52, 58, 64, 66, 166, 167, 183, 199, 215, 231, 248, 273, 289, 295, 304, 314, 316, 331, 344, 360, 398, 402, 417, 432, 441, 451, 460, 471, 487, 499, 514, 529, 544, 557, or 570, and a light chain having the amino acid sequence encoded by the nucleic acid sequence of SEQ ID NOs: 13, 17, 21, 25, 29, 141, 49, 55, 61, 67, 146, 160, 176, 192, 208, 224, 240, 257, 282, 299, 310, 327, 390, 353, 394, 383, 411, 426, 437, 446, 581, 467, 480, 494, 508, 522, 537, 551, 563, or 576. Alternatively, an antibody according to the invention contains a heavy chain variable region having the amino acid sequence encoded by the nucleic acid sequence of SEQ ID NOs: 99, 101, 109, 115, 122, 128, 130, 132, 134, 136, 63, 154, 166, 182, 198, 214, 230, 247, 274, 290, 296, 305, 315, 317, 332, 345, 361, 399, 403, 418, 433, 442, 452, 461, 472, 488, 500, 515, 530, 545, 558, or 571, and a light chain variable region having the amino acid sequence encoded by the nucleic acid sequence of SEQ ID NOs: 100, 106, 112, 119, 125, 129, 131, 133, 135, 137, 147, 159, 175, 191, 207, 223, 239, 256, 283, 300, 311, 328, 391, 354, 395, 384, 412, 427, 438, 447, 582, 468, 481, 495, 509, 523, 538, 552, 564, or 577. Furthermore, an antibody according to the invention contains a heavy chain having the amino acid sequence encoded by a nucleic acid sequence of SEQ ID NOs: 11, 15, 19, 23, 27, 138, 46, 52, 58, 64, 66, 166, 167, 183, 199, 215, 231, 248, 273, 289, 295, 304, 314, 316, 331, 344, 360, 398, 402, 417, 432, 441, 451, 460, 471, 487, 499, 514, 529, 544, 557, or 570, which contains a silent or degenerate mutation, and a light chain having the amino acid sequence encoded by the nucleic acid sequence of SEQ ID NOs: 13, 17, 21, 25, 29, 141, 49, 55, 61, 67, 146, 160, 176, 192, 208, 224, 240, 257, 282, 299, 310, 327, 390, 353, 394, 383, 411, 426, 437, 446, 581, 467, 480, 494, 508, 522, 537, 551, 563, or 576, which contains a silent or degenerate mutation. Silent and degenerate mutations alter the nucleic acid sequence, but do not alter the resultant amino acid sequence.

Preferably the three heavy chain CDRs include an amino acid sequence of at least 90%, 92%, 95%, 97%, 98%, 99%, or more identical to the amino acid sequence of KYGMH (SEQ ID NO: 88), LISDDGMRKYHSDSMWG (SEQ ID NO: 89), EAGGPIWHDDVKYYDFNDGYYNYHYMDV (SEQ ID NO: 6), SYAFT (SEQ ID NO: 104), MVTPIFGEAKYSQRFEG (SEQ ID NO: 105), DRRAVPIATDNWLDP (SEQ ID NO: 9), SYAFS (SEQ ID NO: 110), MITPVFGETKYAPRFQG (SEQ ID NO: 111), DRRVPMATDNWLDP (SEQ ID NO: 8), DYYLH (SEQ ID NO: 116), LIDPENGEARYAEKFQG (SEQ ID NO: 117), GAV-GADSGSWFDP (SEQ ID NO: 10), RQGMH (SEQ ID NO: 123), FIKYDGSEKYHADSVWG (SEQ ID NO: 124), EAGGPDYRNGYNYYDFYDGYYNYHYMDV (SEQ ID NO: 7), LISDDGMRKYHSNSMWG (SEQ ID NO: 98), DSYWS (SEQ ID NO: 90), YVHKSGDTNYSPSLKS (SEQ ID NO: 265), TLHGRRIYGIVAFNEWFTYFYMDV (SEQ ID NO: 143), DNYWS (SEQ ID NO: 261), YVHDSGDTNYNPSLKS (SEQ ID NO: 157), TKHGRRIYGVVAFKEWFTYFYMDV (SEQ ID NO: 262), DAYWS (SEQ ID NO: 169), YVHHSGDTNYNPSLKR (SEQ ID NO: 170), ALHGKRIYGIVALGELFTYFYMDV (SEQ ID NO: 171), ACTYFWG (SEQ ID NO: 185), SLSHCQSFWGSGWTFHNPSLKS (SEQ ID NO: 186), FDGEVLVYNHWPKPAWVDL (SEQ ID NO: 187), ACDYFWG (SEQ ID NO: 201), GLSHCAGYYNTGWTYHNPSLKS (SEQ ID NO: 202), FDGEVLVYHDWPKPAWVDL (SEQ ID NO: 203), TGHYYWG (SEQ ID NO: 217), HIHYTTAVLHNPSLKS (SEQ ID NO: 218), SGGDILYYYEWQKPHWFSP (SEQ ID NO: 219), GGEWGDKDYHWG (SEQ ID NO: 233), SIHWRGTTHYKESLRR (SEQ ID NO: 234), HRHHDVFMLVPIAGWFDV (SEQ ID NO: 235), GTDWGENDFHYG (SEQ ID NO: 250), SIHWRGRTTHYKTSFRS (SEQ ID NO: 251), HKYHDIFRVVPVAGWFDP (SEQ ID NO: 252), KYDVH (SEQ ID NO: 277), WMSHEGDKTESAQRFKG (SEQ ID NO: 278), GSKHRLRDYVLYDDYGLINYQEWNDYLEFLDV (SEQ ID NO: 279), WISHERDKTESAQRFKG (SEQ ID NO: 293), GSKHRLRDYVLYDDYGLINQQEWNDYLEFLDV (SEQ ID NO: 308), RCNYFWG (SEQ ID NO: 320), SLSHCRSYYNTDWTYHNPSLKS (SEQ ID NO: 321), FGGEVLVYRDWPKPAWVDL (SEQ ID NO: 322), ACNSFWG (SEQ ID NO: 326), SLSHCASYWNRGWTYHNPSLKS (SEQ ID NO: 335), FGGEVLRYTDWPKPAWVDL (SEQ ID NO: 336), TGHHYWG (SEQ ID NO: 348), HIHYNTAVLHNPALKS (SEQ ID NO: 349), SGGDILYYIEWQKPHWFYP (SEQ ID NO: 350), GGEWGDSDYHWG (SEQ ID NO: 364), SIHWRGTTHYNAPFRG (SEQ ID NO: 365), HKYHDIVMVVPIAGWFDP (SEQ ID NO: 366), NHDVH (SEQ ID NO: 378), WMSHEGDKTGLAQKFQG (SEQ ID NO: 379), GSKHRLRDYFLYNEYGPNYEEWGDYLATLDV (SEQ ID NO: 380), NYYWT (SEQ ID NO: 406), YISDRETTTYNPSLNS (SEQ ID NO: 407), ARRGQRIYGVVSFGEFFYYYYMDV (SEQ ID NO: 408), GRFWS (SEQ ID NO: 421), YFSDTDRSEYNPSLRS (SEQ ID NO: 422), AQQGKRIYGIVSFGEFFYYYYMDA (SEQ ID NO: 423), AQQGKRIYGIVSFGELFYYYYMDA (SEQ ID NO: 436), SGGDILYYNEWQKPHWFYP (SEQ ID NO: 445), SLSHCAGYYNSGWTYHNPSLKS (SEQ ID NO: 455), FGGDVLVYHDWPKPAWVDL (SEQ ID NO: 456), GCDYFWG (SEQ ID NO: 464), FDGEVLVYNDWPKPAWVDL (SEQ ID NO: 465), KYPMY (SEQ ID NO: 475), AISGDAWHVVYSNSVQG (SEQ ID NO: 476), MFQESGPPRLDRWSGRNYYYYSGMDV (SEQ ID NO: 477), AISADAWHVVYSGSVQG (SEQ ID NO: 491), MFQESGPPRFDSWSGRNYYYYSGMDV (SEQ ID NO: 492), KRHMH (SEQ ID NO: 503), VISSDAIHVDYASSVRG (SEQ ID NO: 504), DRDGYGPPQIQTWSGRYLHLYSGIDA (SEQ ID NO: 505), AISADAWHVDYAASVKD (SEQ ID NO: 518), NIEEFSVPQFDSWSGRSYYHYFGMDV (SEQ ID NO: 519), EYPMY (SEQ ID NO: 533), AISADAWHVDYAGSVRG (SEQ ID NO: 534), DGEEHKVPQLHSWSGRNLYHYTGFDV (SEQ ID NO: 535), QYPMY (SEQ ID NO: 548), AISADAWHVDYPGSVRG (SEQ ID NO: 549), DGEEHEVPQLHSWSGRNLYHYTGVDI (SEQ ID NO: 561), DGEEHEVPQLHSWSGRNLYHYTGVDV (SEQ ID NO: 574), (as determined by the Kabat method) or GFTFHK (SEQ ID NO: 266), LISDDG- MRKY (SEQ ID NO: 267), EAGGPIWHDDVKYYDF-NDGYYNYHYMDV (SEQ ID NO: 6), GGTFSS (SEQ ID NO: 268), MVTPIFGEAK (SEQ ID NO: 269), DRRAVPI-ATDNWLDP (SEQ ID NO: 9), GGAFSS (SEQ ID NO: 270), MITPVFGETK (SEQ ID NO: 271), DRRVVPMATD-NWLDP (SEQ ID NO: 8), GYSFID (SEQ ID NO: 102), LIDPENGEAR (SEQ ID NO: 103), GAVGADSGSWFDP (SEQ ID NO: 10), GFDFSR (SEQ ID NO: 118), FIKYDG-SEKY (SEQ ID NO: 272), EAGGPDYRNGYNYYDFY-DGYYNYHYMDV (SEQ ID NO: 7), GASISD (SEQ ID NO: 144), YVHKSGDTN (SEQ ID NO: 145), TLHGRRI-YGIVAFNEWFTYFYMDV (SEQ ID NO: 143), GTLVRD (SEQ ID NO: 263), YVHDSGDTN (SEQ ID NO: 264), TKHGRRIYGVVAFKEWFTYFYMDV (SEQ ID NO: 262), GASIND (SEQ ID NO: 172), YVHHSGDTN (SEQ ID NO: 173), ALHGKRIYGIVALGELFTYFYMDV (SEQ ID NO: 171), GESTGACT (SEQ ID NO: 188), SLSHCQSF-WGSGWTF (SEQ ID NO: 189), FDGEVLVYNHWPK-PAWVDL (SEQ ID NO: 187), GDSTAACD (SEQ ID NO: 204), GLSHCAGYYNTGWTY (SEQ ID NO: 205), FDGEVLVYHDWPKPAWVDL (SEQ ID NO: 203), GES-INTGH (SEQ ID NO: 220), HIHYTTAVL (SEQ ID NO: 221), SGGDILYYYEWQKPHWFSP (SEQ ID NO: 219), GDSIRGGEWGDKD (SEQ ID NO: 236), SIHWRGTTH (SEQ ID NO: 237), HRHHDVFMLVPIAGWFDV (SEQ ID NO: 235), GGSMRGTDWGEND (SEQ ID NO: 253), SIH-WRGRTTH (SEQ ID NO: 254), HKYHDIFRVVPVAG-WFDP (SEQ ID NO: 252), GNTFSK (SEQ ID NO: 280), WMSHEGDKTE (SEQ ID NO: 281), GSKHRLRDYV-LYDDYGLINYQEWNDYLEFLDV (SEQ ID NO: 279), WISHERDKTE (SEQ ID NO: 294), GSKHRLRDYVLYD-DYGLINQQEWNDYLEFLDV (SEQ ID NO: 308), or GNTFRK (SEQ ID NO: 309), GDSTGRCN (SEQ ID NO: 323), SLSHCRSYYNTDWTY (SEQ ID NO: 324), FGGEVLVYRDWPKPAWVDL (SEQ ID NO: 322), GDSTAACN (SEQ ID NO: 337), SLSHCASYWNRGWTY (SEQ ID NO: 338), FGGEVLRYTDWPKPAWVDL (SEQ ID NO: 336), GDSINTGH (SEQ ID NO: 351), HIHYN-TAVL (SEQ ID NO: 352), SGGDILYYIEWQKPHWFYP (SEQ ID NO: 350), GGSIRGGEWGDSD (SEQ ID NO: 367), SIHWRGTTH (SEQ ID NO: 237), HKYHDIVMV-VPIAGWFDP (SEQ ID NO: 366), GNSFSN (SEQ ID NO: 381), WMSHEGDKTG (SEQ ID NO: 382), GSKHRLRDY-FLYNEYGPNYEEWGDYLATLDV (SEQ ID NO: 380), GGSISN (SEQ ID NO: 409), YISDRETTT (SEQ ID NO: 410), ARRGQRIYGVVSFGEFFYYYYMDV (SEQ ID NO: 408), NGSVSG (SEQ ID NO: 424), YFSDTDRSE (SEQ ID NO: 425), AQQGKRIYGIVSFGEFFYYYYMDA (SEQ ID NO: 423), AQQGKRIYGIVSFGELFYYYYMDA (SEQ ID NO: 436), SGGDILYYNEWQKPHWFYP (SEQ ID NO: 445), SLSHCAGYYNSGWTY (SEQ ID NO: 457), FGGD-VLVYHDWPKPAWVDL (SEQ ID NO: 456), GDSTAGCD (SEQ ID NO: 466), FDGEVLVYNDWPKPAWVDL (SEQ ID NO: 465), DFPFSK (SEQ ID NO: 478), AISGDAWHVV (SEQ ID NO: 479), MFQESGPPRLDRWSGRNYYYYS-GMDV (SEQ ID NO: 477), AISADAWHVV (SEQ ID NO: 493), MFQESGPPRFDSWSGRNYYYYSGMDV (SEQ ID NO: 492), NFLFNK (SEQ ID NO: 506), VISSDAIHVD (SEQ ID NO: 507), DRDGYGPPQIQTWSGRYLHLYS-GIDA (SEQ ID NO: 505), NFIFNK (SEQ ID NO: 520), AISADAWHVD (SEQ ID NO: 521), NIEEFSVPQFDSWS-GRSYYHYFGMDV (SEQ ID NO: 519), GFIFNE (SEQ ID NO: 536), DGEEHKVPQLHSWSGRNLYHYTGFDV (SEQ ID NO: 535), GFIFNQ (SEQ ID NO: 550), GFIFKQ (SEQ ID NO: 562), DGEEHEVPQLHSWSGRNLYHYT-GVDI (SEQ ID NO: 561), GFIFKK (SEQ ID NO: 575), DGEEHEVPQLHSWSGRNLYHYTGVDV (SEQ ID NO: 574), (as determined by the Chothia method), and a light chain with three CDRs that include an amino acid sequence of at least 90%, 92%, 95%, 97%, 98%, 99%, or more identical to the amino acid sequence of NGTSSDVG-GFDSVS (SEQ ID NO: 97), DVSHRPS (SEQ ID NO: 95), SSLTDRSHRI (SEQ ID NO: 41), RASQTINNYLN (SEQ ID NO: 107), GASNLQN (SEQ ID NO: 108), QQSFSTPRT (SEQ ID NO: 42), RASQTIHTYLN (SEQ ID NO: 113), GASTLQS (SEQ ID NO: 114), QQSYSTPRT (SEQ ID NO: 43), SGSKLGDKYVS (SEQ ID NO: 120), ENDRRPS (SEQ ID NO: 121), QAWETTTTTFVF (SEQ ID NO: 44), NGTSNDVGGYESVS (SEQ ID NO: 126), DVSKRPS (SEQ ID NO: 127), KSLTSTRRRV (SEQ ID NO: 45), NGTRSDVGGFDSVS (SEQ ID NO: 92), NGTSRDVG-GFDSVS (SEQ ID NO: 93), GEKSLGSRAVQ (SEQ ID NO: 150), NNQDRPS (SEQ ID NO: 151), HIWDSRVPT-KWV (SEQ ID NO: 152), GEESLGSRSVI (SEQ ID NO: 162), NNNDRPS (SEQ ID NO: 163), HIWDSRRPTNWV (SEQ ID NO: 164), GKESIGSRAVQ (SEQ ID NO: 178), NNQDRPA (SEQ ID NO: 179), HIYDARGGTNWV (SEQ ID NO: 180), NGTATNFVS (SEQ ID NO: 194), GVDKRPP (SEQ ID NO: 195), GSLVGNWDVI (SEQ ID NO: 196), TGTSNRFVS (SEQ ID NO: 210), GVNKRPS (SEQ ID NO: 211), SSLVGNWDVI (SEQ ID NO: 212), NGTSS-DIGGWNFVS (SEQ ID NO: 226), EVNKRPS (SEQ ID NO: 227), SSLFGRWDVV (SEQ ID NO: 228), RASQNINKNLA (SEQ ID NO: 243), ETYSKIA (SEQ ID NO: 244), QQYEEWPRT (SEQ ID NO: 245), RASQN-VKNNLA (SEQ ID NO: 259), DASSRAG (SEQ ID NO: 260), SSTQSLRHSNGANYLA (SEQ ID NO: 286), LGSQRAS (SEQ ID NO: 287), MQGLNRPWT (SEQ ID NO: 288), or TSTQSLRHSNGANYLA (SEQ ID NO: 303), TGTSNNFVS (SEQ ID NO: 325), DVNKRPS (SEQ ID NO: 343), GSLVGNWDVI (SEQ ID NO: 196), SGTGS-DIGSWNFVS (SEQ ID NO: 357), EVNRRRS (SEQ ID NO: 358), SSLSGRWDIV (SEQ ID NO: 359), RASQS-VKNNLA (SEQ ID NO: 372), DTSSRAS (SEQ ID NO: 373), KCSHSLQHSTGANYLA (SEQ ID NO: 387), LATH-RAS (SEQ ID NO: 388), MQGLHSPWT (SEQ ID NO: 389), GRQALGSRAVQ (SEQ ID NO: 415), HMWDSRS-GFSWS (SEQ ID NO: 416), GERSRGSRAVQ (SEQ ID NO: 430), HYWDSRSPISWI (SEQ ID NO: 431), SGTAS-DIGSWNFVS (SEQ ID NO: 450), TGNINNFVS (SEQ ID NO: 458), GSLAGNWDVV (SEQ ID NO: 459), KSSESL-RQSNGKTSLY (SEQ ID NO: 484), EVSNRFS (SEQ ID NO: 485), MQSKDFPLT (SEQ ID NO: 486), KSSQSL-RQSNGKTSLY (SEQ ID NO: 498), KSSQSLRQSNGK-TYLY (SEQ ID NO: 512), EVSIRFS (SEQ ID NO: 513), SSSESLGRGDGRTYLH (SEQ ID NO: 526), EVSTRFS (SEQ ID NO: 527), MQSRDFPIT (SEQ ID NO: 528), KSSQSVRQSDGKTFLY (SEQ ID NO: 541), EGSSRFS (SEQ ID NO: 542), LQTKDFPLT (SEQ ID NO: 543), KSSQTVRQSDGKTFLY (SEQ ID NO: 555), EGSNRFS (SEQ ID NO: 556), KSSQSLRQSDGKTFLY (SEQ ID NO: 567), EASNRFS (SEQ ID NO: 568), MQTKDFPLT (SEQ ID NO: 569), EASKRFS (SEQ ID NO: 580), (as determined by the Kabat method), or NGTSSDVGGFDSVS (SEQ ID NO: 97), DVSHRPS (SEQ ID NO: 95), SSLTDRSHRI (SEQ ID NO: 41), RASQTINNYLN (SEQ ID NO: 107), GASNLQN (SEQ ID NO: 108), QQSFSTPRT (SEQ ID NO: 42), RASQTIHTYLN (SEQ ID NO: 113), GASTLQS (SEQ ID NO: 114), QQSYSTPRT (SEQ ID NO: 43), SGSKLGD-KYVS (SEQ ID NO: 120), ENDRRPS (SEQ ID NO: 121), QAWETTTTTFVF (SEQ ID NO: 44), NGTSNDVG-GYESVS (SEQ ID NO: 126), DVSKRPS (SEQ ID NO: 127), KSLTSTRRRV (SEQ ID NO: 45), NGTRSDVG-GFDSVS (SEQ ID NO: 92), NGTSRDVGGFDSVS (SEQ ID NO: 93) GEKSLGSRAVQ (SEQ ID NO: 150), NNQDRPS (SEQ ID NO: 151), HIWDSRVPTKWV (SEQ ID NO: 152), GEESLGSRSVI (SEQ ID NO: 162), NNNDRPS (SEQ ID NO: 163), HIWDSRRPTNWV (SEQ ID NO: 164), GKESIGSRAVQ (SEQ ID NO: 178), NNQDRPA (SEQ ID NO: 179), HIYDARGGTNWV (SEQ ID NO: 180), NGTATNFVS (SEQ ID NO: 194), GVDKRPP (SEQ ID NO: 195), GSLVGNWDVI (SEQ ID NO: 196), TGTSNRFVS (SEQ ID NO: 210), GVNKRPS (SEQ ID NO: 211), SSLVGNWDVI (SEQ ID NO: 212), NGTSSDIGGWNFVS (SEQ ID NO: 226), EVNKRPS (SEQ ID NO: 227), SSLFGRWDVV (SEQ ID NO: 228), RASQNINKNLA (SEQ ID NO: 243), ETYSKIA (SEQ ID NO: 244), QQYEEWPRT (SEQ ID NO: 245), RASQNVKNNLA (SEQ ID NO: 259), DASSRAG (SEQ ID NO: 260), SSTQSLRHSNGANYLA (SEQ ID NO: 286), LGSQRAS (SEQ ID NO: 287), MQGLNRPWT (SEQ ID NO: 288), TSTQSLRHSNGANYLA (SEQ ID NO: 303), TGTSNNFVS (SEQ ID NO: 325), DVNKRPS (SEQ ID NO: 343), GSLVGNWDVI (SEQ ID NO: 196), SGTGSDIGSWNFVS (SEQ ID NO: 357), EVNRRRS (SEQ ID NO: 358), SSLSGRWDIV (SEQ ID NO: 359), RASQSVKNNLA (SEQ ID NO: 372), DTSSRAS (SEQ ID NO: 373), KCSHSLQHSTGANYLA (SEQ ID NO: 387), LATHRAS (SEQ ID NO: 388), MQGLHSPWT (SEQ ID NO: 389), GRQALGSRAVQ (SEQ ID NO: 415), HMWDSRSGFSWS (SEQ ID NO: 416), GERSRGSRAVQ (SEQ ID NO: 430), HYWDSRSPISWI (SEQ ID NO: 431), SGTASDIGSWNFVS (SEQ ID NO: 450), TGNINNFVS (SEQ ID NO: 458), GSLAGNWDVV (SEQ ID NO: 459), KSSESLRQSNGKTSLY (SEQ ID NO: 484), EVSNRFS (SEQ ID NO: 485), MQSKDFPLT (SEQ ID NO: 486), KSSQSLRQSNGKTSLY (SEQ ID NO: 498), KSSQSLRQSNGKTYLY (SEQ ID NO: 512), EVSIRFS (SEQ ID NO: 513), SSSESLGRGDGRTYLH (SEQ ID NO: 526), EVSTRFS (SEQ ID NO: 527), MQSRDFPIT (SEQ ID NO: 528), KSSQSVRQSDGKTFLY (SEQ ID NO: 541), EGSSRFS (SEQ ID NO: 542), LQTKDFPLT (SEQ ID NO: 543), KSSQTVRQSDGKTFLY (SEQ ID NO: 555), EGSNRFS (SEQ ID NO: 556), KSSQSLRQSDGKTFLY (SEQ ID NO: 567), EASNRFS (SEQ ID NO: 568), MQTKDFPLT (SEQ ID NO: 569), EASKRFS (SEQ ID NO: 580), (as determined by the Chothia method).

The heavy chain of the anti-HIV monoclonal antibody is derived from a germ line variable (V) gene such as, for example, the IGHV1, IGHV3, or IGHV4 germline gene or an allele thereof.

The anti-HIV antibodies of the invention include a variable heavy chain ($V_H$) region encoded by a human IGHV1, IGHV3, or IGHV4 germline gene sequence or an allele thereof. Antibodies of the invention are derived from the IGHV1-2, IGHV1-8, or IGHV1-46 genes, or an allele thereof. Exemplary alleles of the IGHV1 germline gene include, but are not limited to, IGHV1-2*02, IGHV1-2*04, IGHV1-8*01, IGHV1-46*01, IGHV1-46*02, or IGHV1-46*03. IGHV1 germline gene sequences are shown, e.g., in Accession numbers L22582, X27506, X92340, M83132, X67905, L22583, Z29978, Z14309, Z14307, Z14300, Z14296, and Z14301. IGHV3 germline gene sequences are shown, e.g., in Accession numbers AB019439, M99665, M77305, M77335, and M77334. Antibodies of the invention are derived from the IGHV4-59, IGHV4-64, IGHV4-b, IGHV4-39, or IGHV4-28 genes, or an allele thereof. Exemplary alleles of the IGHV4 germline gene include, but are not limited to, IGHV4-59*01, IGHV4-59*07, IGHV4-59*02, IGHV4-59*03, IGHV4-59*04, IGHV4-61*08, IGHV4-b*02, IGHV4-b*01, IGHV4-39*07, IGHV4-39*03, IGHV4-39*06, IGHV4-39*01, IGHV4-39*02, or IGHV4-28*05. IGHV4 germline gene sequences are shown, e.g., in Accession numbers AB019439, L10094, X05715, X92259, X92297, M95116, Z14236, AM940222, X54447, X56362, Z14075, Z75352, AB019438, M29812, M95114, M95117, M95118, M95119, X56360, X87091, Z75359, Z14243, L10088, U03896, X56355, X56359, X92248, X92296, Z12371, M29811, L10097, X92230, X92250, X56356, Z75347, Z75348, AB019437, M95111, X92249, X92251, Z12366, Z75346, Z75361, Z12367, X56365, and X92289. The anti-HIV antibodies of the invention include a $V_H$ region that is encoded by a nucleic acid sequence that is at least 80% homologous to the IGHV1, IGHV3, or IGHV4 germline gene sequence or an allele thereof. Preferably, the nucleic acid sequence is at least 90%, 95%, 96%, 97% homologous to the IGHV1, IGHV3, or IGHV4 germline gene sequence, and more preferably, at least 98%, 99% homologous to the IGHV1, IGHV3, or IGHV4 germline gene sequence or an allele thereof. The $V_H$ region of the anti-HIV antibody is at least 80% homologous to the amino acid sequence of the $V_H$ region encoded by the IGHV1, IGHV3, or IGHV4 germline gene sequence or an allele thereof. Preferably, the amino acid sequence of $V_H$ region of the anti-HIV antibody is at least 90%, 95%, 96%, 97% homologous to the amino acid sequence encoded by the IGHV1, IGHV3, or IGHV4 germline gene sequence or an allele thereof, and more preferably, at least 98%, 99% homologous to the sequence encoded by the IGHV1, IGHV3, or IGHV4 germline gene sequence or an allele thereof.

The light chain of the anti-HIV monoclonal antibody is derived from a germ line variable (V) gene such as, for example, the IGLV2, IGLV3, IGKV1, IGKV2, IGKV2D, or IGKV3 germline gene or an allele thereof.

The anti-HIV antibodies of the invention also include a variable light chain ($V_L$) region encoded by a human IGLV2, IGLV3, IGKV1, IGKV2, IGKV2D, IGKV3, or IGKV3D germline gene or an allele thereof. A human IGLV2 $V_L$ germline gene sequence is shown, e.g., Accession numbers Z73664, L27822, Y12412, and Y12413. A human IGLV3 $V_L$ germline gene sequence is shown, e.g., Accession number X57826. Antibodies of the invention are derived from the IGLV2-8 germline gene, or an allele thereof.

Exemplary alleles of the IGLV2-8 germline gene include, but are not limited to, IGLV2-8*01 and IGLV2-8*02. Antibodies of the invention are derived from the IGLV3-21 germline gene, or an allele thereof. Exemplary alleles of the IGLV3-21 germline gene include, but are not limited to, IGLV3-21*01, IGLV3-21*02, and IGLV3-21*03. Antibodies of the invention are derived from the IGKV2-28 and IGKV2D-28 germline genes, or an allele thereof. Exemplary alleles of the IGKV2-28 and IGKV2D-28 germline genes include, but are not limited to, IGKV2-28*01 and IGKV2D-28*01. Antibodies of the invention are derived from the IGKV3-15 and IGKV3D-15 germline genes, or an allele thereof. Exemplary alleles of the IGKV3-15 and IGKV3D-15 germline genes include, but are not limited to, IGKV3-15*01, IGKV3D-15*01, and IGKV3D-15*02(P).

A human IGLV2 $V_L$ germline gene sequence is shown, e.g., Accession numbers Z73657, Z73664, Z73642, X14616, X97466, Z73643, D87013, Z73641, X97462, D87021, Y12417, L27695, and Z22209. A human IGLV3 $V_L$ germline gene sequence is shown, e.g., Accession numbers X57826, X97464, Z73658, X97463, D87015, X97471, X97472, X56178, X97468, X71966, D87007, M94115, Z73666, X71968, X97474, X97467, D86994, Z73644, Z73646, X97469, Z73645, D87024, X97465, X97470, and X97473. A human IGKV1 $V_L$ germline gene sequence is shown, e.g., Accession numbers AF306358, AF490911, L12062, L12064, L12065, L12066, L12068, L12072, L12075, L12076, L12079, L12080, L12081, L12082, L12083, L12084, L12085, L12086, 12088, L12091, L12093, L12101, L12106, L12108, L12110, L12112, M95721, M95722, M95723, X73855, X73860, X98972, X98973, Z15073, Z15074, Z15075, Z15077, Z15079, Z15081. A human IGKV3 $V_L$ germline gene sequence is shown, e.g., Accession numbers X01668, M23090, X12686, X06583, X71883, X71891, X02725, L37728, L37727, L37730, L19271, L19272, X17264, X72815, X12687, X71886, X71896, X71895, X72820.

Alternatively, the anti-HIV antibodies include a $V_L$ region that is encoded by a nucleic acid sequence that is at least 80% homologous to the IGLV2, IGLV3, IGKV1, IGKV2, IGKV2D, IGKV3, or IGKV3D germline gene or an allele thereof. Preferably, the nucleic acid sequence is at least 90%, 95%, 96%, 97% homologous to the IGLV2, IGLV3, IGKV1, IGKV2, IGKV2D, IGKV3, or IGKV3D germline gene or an allele thereof, and more preferably, at least 98%, 99% homologous to the IGLV2, IGLV3, IGKV1, IGKV2, IGKV2D, IGKV3, or IGKV3D germline gene or an allele thereof. The $V_L$ region of the anti-HIV antibody is at least 80% homologous to the amino acid sequence of the $V_L$ region encoded the IGLV2, IGLV3, IGKV1, IGKV2, IGKV2D, IGKV3, or IGKV3D germline gene or an allele thereof. Preferably, the amino acid sequence of $V_L$ region of the anti-HIV antibody is at least 90%, 95%, 96%, 97% homologous to the amino acid sequence encoded by the IGLV2, IGLV3, IGKV1, IGKV2, IGKV2D, IGKV3, or IGKV3D germline gene or an allele thereof, and more preferably, at least 98%, 99% homologous to the sequence encoded by the IGLV2, IGLV3, IGKV1, IGKV2, IGKV2D, IGKV3, or IGKV3D germline gene or an allele thereof.

TABLE 11

Consensus nucleotide sequences of Kabat CDRs of heavy chains of 1443 PG16 sister clones.

CDR1 (kabat):

| | |
|---|---|
| 1443 C16 | AAATATGGCATGCAC (SEQ ID NO: 68) |
| 1469 M23 | AAATATGGCATGCAC (SEQ ID NO: 68) |
| 1456 A12 | AAATATGGCATGCAC (SEQ ID NO: 68) |
| 1503 H05 | AAATATGGCATGCAC (SEQ ID NO: 68) |
| 1489 I13 | AAATATGGCATGCAC (SEQ ID NO: 68) |
| 1480 I08 | AAATATGGCATGCAC (SEQ ID NO: 68) |
| Consensus | AAATATGGCATGCAC (SEQ ID NO: 68) |

CDR1 (chothia):

| | |
|---|---|
| 1443 C16 | TCTGGATTCACGTTTCACAAA (SEQ ID NO: 69) |
| 1469 M23 | TCTGGATTCACCTTTCACAAA (SEQ ID NO: 70) |
| 1456 A12 | TCTGGATTCACGTTTCACAAA (SEQ ID NO: 69) |
| 1503 H05 | TCTGGATTCACCTTTCACAAA (SEQ ID NO: 70) |
| 1489 I13 | TCTGGATTCACGTTTCACAAA (SEQ ID NO: 69) |
| 1480 I08 | TCTGGATTCACGTTTCACAAA (SEQ ID NO: 69) |
| Consensus* | TCTGGATTCACXTTTCACAAA (SEQ ID NO: 71) |
| Variation1 | TCTGGATTCACGTTTCACAAA (SEQ ID NO: 69) |
| Variation2 | TCTGGATTCACCTTTCACAAA (SEQ ID NO: 70) |

*Wherein X is C or G.

CDR2:

| | |
|---|---|
| 1443 C16 | CTCATCTCAGATGACGGAATGAGGAAATATCATTCAGACTCCATGTGGGGC (SEQ ID NO: 72) |
| 1469 M23 | CTCATCTCAGATGACGGAATGAGGAAATATCATTCAGACTCCATGTGGGGC (SEQ ID NO: 72) |
| 1456 A12 | CTCATCTCAGATGACGGAATGAGGAAATATCATTCAGACTCCATGTGGGGC (SEQ ID NO: 72) |
| 1503 H05 | CTCATCTCAGATGACGGAATGAGGAAATATCATTCAGACTCCATGTGGGGC (SEQ ID NO: 72) |
| 1489 I13 | CTCATCTCAGATGACGGAATGAGGAAATATCATTCAAACTCCATGTGGGGC (SEQ ID NO: 73) |
| 1480 I08 | CTCATCTCAGATGACGGAATGAGGAAATATCATTCAGACTCCATGTGGGGC (SEQ ID NO: 72) |
| Consensus* | CTCATCTCAGATGACGGAATGAGGAAATATCATTCAXACTCCATGTGGGGC (SEQ ID NO: 74) |
| Variation1 | CTCATCTCAGATGACGGAATGAGGAAATATCATTCAGACTCCATGTGGGGC (SEQ ID NO: 72) |
| Variation2 | CTCATCTCAGATGACGGAATGAGGAAATATCATTCAAACTCCATGTGGGGC (SEQ ID NO: 73) |

*Wherein X is A or G.

CDR3:

1443 C16 (SEQ ID NO: 75)
GAGGCTGGTGGGCCAATCTGGCATGACGACGTCAAATATTACGATTTTAATGAC
GGCTACTACAACTACCACTACATGGACGTC

TABLE 11-continued

Consensus nucleotide sequences of Kabat CDRs of heavy chains of 1443 PG16 sister clones.

1469 M23 (SEQ ID NO: 75)
GAGGCTGGTGGGCCAATCTGGCATGACGACGTCAAATATTACGATTTTAATGAC
GGCTACTACAACTACCACTACATGGACGTC
1456 A12 (SEQ ID NO: 77)
GAGGCCGGTGGGCCAATCTGGCATGACGACGTCAAATATTACGATTTTAATGAC
GGCTACTACAACTATCACTACATGGACGTC
1503 H05 (SEQ ID NO:79)
GAGGCTGGTGGGCCAATCTGGCATGACGACGTCAAATATTACGATTTTAATGAC
GGCTACTACAATTACCACTACATGGACGTC
1489 I13 (SEQ ID NO: 75)
GAGGCTGGTGGGCCAATCTGGCATGACGACGTCAAATATTACGATTTTAATGAC
GGCTACTACAACTACCACTACATGGACGTC
1480 I08 (SEQ ID NO: 75)
GAGGCTGGTGGGCCAATCTGGCATGACGACGTCAAATATTACGATTTTAATGAC
GGCTACTACAACTACCACTACATGGACGTC
Consensus (SEQ ID NO: 76)
GAGGCXGGTGGGCCAATCTGGCATGACGACGTCAAATATTACGATTTTAATGAC
GGCTACTACAACTATCACTACATGGACGTC
Variation1 (SEQ ID NO: 78)
GAGGCGGGTGGGCCAATCTGGCATGACGACGTCAAATATTACGATTTTAATGAC
GGCTACTACAACTATCACTACATGGACGTC
Variation2 (SEQ ID NO: 77)
GAGGCCGGTGGGCCAATCTGGCATGACGACGTCAAATATTACGATTTTAATGAC
GGCTACTACAACTATCACTACATGGACGTC

*Wherein X is T, C or G.

TABLE 12

Consensus nucleotide sequences of Kabat CDRs of light chains of 1443 PG16 sister clones.

CDR1:

| | | |
|---|---|---|
| 1443 C16 | AATGGAACCAGCAGTGACGTTGGTGGATTTGACTCTGTCTCC | (SEQ ID NO: 80) |
| 1469 M23 | AATGGAACCAGAAGTGACGTTGGTGGATTTGACTCTGTCTCC | (SEQ ID NO: 82) |
| 1456 A12 | AATGGAACCAGCCGTGACGTTGGTGGATTTGACTCTGTCTCC | (SEQ ID NO: 83) |
| 1503 H05 | AATGGAACCAGAAGTGACGTTGGTGGATTTGACTCTGTCTCC | (SEQ ID NO: 82) |
| 1489 I13 | AATGGAACCAGCAGTGACGTTGGTGGATTTGACTCTGTCTCC | (SEQ ID NO: 80) |
| 1480 I08 | AATGGAACCAGCAGTGACGTTGGTGGATTTGACTCTGTCTCC | (SEQ ID NO: 80) |
| Consensus* | AATGGAACCAGX₁X₂GTGACGTTGGTGGATTTGACTCTGTCTCC | (SEQ ID NO: 81) |
| Variation1 | AATGGAACCAGCAGTGACGTTGGTGGATTTGACTCTGTCTCC | (SEQ ID NO: 80) |
| Variation2 | AATGGAACCAGAAGTGACGTTGGTGGATTTGACTCTGTCTCC | (SEQ ID NO: 82) |
| Variation2 | AATGGAACCAGCCGTGACGTTGGTGGATTTGACTCTGTCTCC | (SEQ ID NO: 83) |

*Wherein X₁ is C or A. Wherein X₂ is C or A.

CDR2:

| | | |
|---|---|---|
| 1443 C16 | GATGTCAGTCATCGGCCCTCA | (SEQ ID NO: 84) |
| 1469 M23 | GATGTCAGTCATCGGCCCTCA | (SEQ ID NO: 84) |
| 1456 A12 | GATGTCAGTCATCGGCCCTCA | (SEQ ID NO: 84) |
| 1503 H05 | GATGTCAGTCATCGGCCCTCA | (SEQ ID NO: 84) |
| 1489 I13 | GATGTCAGTCATCGGCCCTCA | (SEQ ID NO: 84) |
| 1480 I08 | GATGTCAGTCATCGGCCCTCA | (SEQ ID NO: 84) |
| Consensus | GATGTCAGTCATCGGCCCTCA | (SEQ ID NO: 84) |

CDR3:

| | | |
|---|---|---|
| 1443 C16 | TCTTCACTGACAGACAGAAGCCATCGCATA | (SEQ ID NO: 85) |
| 1469 M23 | TCTTCACTGACAGACAGAAGCCATCGCATA | (SEQ ID NO: 85) |
| 1456 A12 | TCTTCATTGACAGACAGAAGCCATCGCATA | (SEQ ID NO: 86) |
| 1503 H05 | TCTTCACTGACAGACAGAAGCCATCGCATA | (SEQ ID NO: 85) |

TABLE 12-continued

Consensus nucleotide sequences of Kabat CDRs of light chains of 1443 PG16 sister clones.

| | | |
|---|---|---|
| 1489 I13 | TCTTCACTGACAGACAGAAGCCATCGCATA | (SEQ ID NO: 85) |
| 1480 I08 | TCTTCACTGACAGACAGAAGCCATCGCATA | (SEQ ID NO: 85) |
| Consensus* | TCTTCAXTGACAGACAGAAGCCATCGCATA | (SEQ ID NO: 87) |
| Variation1 | TCTTCACTGACAGACAGAAGCCATCGCATA | (SEQ ID NO: 85) |
| Variation2 | TCTTCATTGACAGACAGAAGCCATCGCATA | (SEQ ID NO: 86) |

*Wherein $X_1$ is C or T and wherein $X_2$ is C or T.

TABLE 13

Consensus protein sequences of Kabat CDRs of Heavy chains of 1443 PG16 sister clones.

CDR1:

| | | |
|---|---|---|
| 1443 C16 | KYGMH | (SEQ ID NO: 88) |
| 1469 M23 | KYGMH | (SEQ ID NO: 88) |
| 1456 A12 | KYGMH | (SEQ ID NO: 88) |
| 1503 H05 | KYGMH | (SEQ ID NO: 88) |
| 1489 I13 | KYGMH | (SEQ ID NO: 88) |
| 1480 I08 | KYGMH | (SEQ ID NO: 88) |
| Consensus | KYGMH | (SEQ ID NO: 88) |

CDR2:

| | | |
|---|---|---|
| 1443 C16 | LISDDGMRKYHSDSMWG | (SEQ ID NO: 89) |
| 1469 M23 | LISDDGMRKYHSDSMWG | (SEQ ID NO: 89) |
| 1456 A12 | LISDDGMRKYHSDSMWG | (SEQ ID NO: 89) |
| 1503 H05 | LISDDGMRKYHSDSMWG | (SEQ ID NO: 89) |
| 1489 I13 | LISDDGMRKYHSNSMWG | (SEQ ID NO: 98) |
| 1480 I08 | LISDDGMRKYHSDSMWG | (SEQ ID NO: 89) |
| Consensus* | LISDDGMRKYHSXSMWG | (SEQ ID NO: 91) |
| Variation1 | LISDDGMRKYHSDSMWG | (SEQ ID NO: 89) |
| Variation2 | LISDDGMRKYHSNSMWG | (SEQ ID NO: 98) |

CDR3:

| | | |
|---|---|---|
| 1443 C16 | EAGGPIWHDDVKYYDFNDGYYNYHYMDV | (SEQ ID NO: 6) |
| 1469 M23 | EAGGPIWHDDVKYYDFNDGYYNYHYMDV | (SEQ ID NO: 6) |
| 1456 A12 | EAGGPIWHDDVKYYDFNDGYYNYHYMDV | (SEQ ID NO: 6) |
| 1503 H05 | EAGGPIWHDDVKYYDFNDGYYNYHYMDV | (SEQ ID NO: 6) |
| 1489 I13 | EAGGPIWHDDVKYYDFNDGYYNYHYMDV | (SEQ ID NO: 6) |
| 1480 I08 | EAGGPIWHDDVKYYDFNDGYYNYHYMDV | (SEQ ID NO: 6) |
| Consensus | EAGGPIWHDDVKYYDFNDGYYNYHYMDV | (SEQ ID NO: 6) |

*Wherein X is D or N, or wherein X is an amino acid with similar physical properties to either D or N.

TABLE 14

Consensus protein sequences of Kabat CDRs of light chains of 1443 PG16 sister clones.

CDR1:

| | | |
|---|---|---|
| 1443 C16 | NGTSSDVGGFDSVS | (SEQ ID NO: 97) |
| 1469 M23 | NGTSRDVGGFDSVS | (SEQ ID NO: 92) |
| 1456 A12 | NGTSRDVGGFDSVS | (SEQ ID NO: 93) |
| 1503 H05 | NGTSRDVGGFDSVS | (SEQ ID NO: 92) |
| 1489 I13 | NGTSSDVGGFDSVS | (SEQ ID NO: 97) |
| 1480 I08 | NGTSSDVGGFDSVS | (SEQ ID NO: 97) |
| Consensus* | NGTX$_1$X$_2$DVGGFDSVS | (SEQ ID NO: 94) |
| Variation1 | NGTSSDVGGFDSVS | (SEQ ID NO: 97) |
| Variation2 | NGTSRDVGGFDSVS | (SEQ ID NO: 92) |
| Variation3 | NGTSRDVGGFDSVS | (SEQ ID NO: 93) |

CDR2:

| | | |
|---|---|---|
| 1443 C16 | DVSHRPS | (SEQ ID NO: 95) |
| 1469 M23 | DVSHRPS | (SEQ ID NO: 95) |
| 1456 A12 | DVSHRPS | (SEQ ID NO: 95) |
| 1503 H05 | DVSHRPS | (SEQ ID NO: 95) |

TABLE 14-continued

Consensus protein sequences of Kabat CDRs of light chains of 1443 PG16 sister clones.

| | | |
|---|---|---|
| 1489 I13 | DVSHRPS | (SEQ ID NO: 95) |
| 1408 I08 | DVSHRPS | (SEQ ID NO: 95) |
| Consensus | DVSHRPS | (SEQ ID NO: 95) |

| CDR3: | | |
|---|---|---|
| 1443 C16 | SSLTDRSHRI | (SEQ ID NO: 41) |
| 1469 M23 | SSLTDRSHRI | (SEQ ID NO: 41) |
| 1456 A12 | SSLTDRSHRI | (SEQ ID NO: 41) |
| 1503 H05 | SSLTDRSHRI | (SEQ ID NO: 41) |
| 1489 I13 | SSLTDRSHRI | (SEQ ID NO: 41) |
| 1480 I08 | SSLTDRSHRI | (SEQ ID NO: 41) |
| Consensus | SSLTDRSHRI | (SEQ ID NO: 41) |

*Wherein X1 is S or R, or wherein X1 is an amino acid with similar physical properties to either S or R. Wherein X2 is S or R, or wherein X2 is an amino acid with similar physical properties to either S or R.

Monoclonal and recombinant antibodies are particularly useful in identification and purification of the individual polypeptides or other antigens against which they are directed. The antibodies of the invention have additional utility in that they may be employed as reagents in immunoassays, radioimmunoassays (RIA) or enzyme-linked immunosorbent assays (ELISA). In these applications, the antibodies can be labeled with an analytically-detectable reagent such as a radioisotope, a fluorescent molecule or an enzyme. The antibodies may also be used for the molecular identification and characterization (epitope mapping) of antigens.

As mentioned above, the antibodies of the invention can be used to map the epitopes to which they bind. Applicants have discovered that the antibodies 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and/or 6881_N05 (PGT-158) neutralize HIV. Although the Applicant does not wish to be bound by this theory, it is postulated that the antibodies 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_S09 (PG9) (TCN-109), 4838_L06 (PGT-121), 4873_E03 (PGT-121), 4877_D15 (PGT-122), 4858_P08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_I01 (PGT-137), 4993_1(13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and/or 6881_N05 (PGT-158) bind to one or more conformational epitopes formed by HIV1-encoded proteins.

Neutralization activity of human monoclonal antibodies was tested against HIV-1 strains SF162 and JR-CSF. HIV-1 strains SF162 and JR-CSF both belong to HIV clade B. Each clonal monoclonal antibody was screened for neutralization activity and for anti-gp120, anti-gp41 and total IgG in quantitative ELISA. For the monoclonal antibodies 1456_P20, 1495_C14, and 1460_G14 anti-gp120 antigen-specific binding was detected. Neutralizing activity against SF162, but not JR-CSF was detected for 1456_P20 (PG20), 1495_C14 (PGC14), and 1460_G14 (PGG14). For the two monoclonal antibody preparations that did not show binding to gp120 in the ELISA assay, 1443_C16 (PG16) and 1496_C09 (PG9), high quantities of human IgG were determined to be present in the assay. However, 1443_C16 (PG16) and 1496_C09 (PG9) both were found to exhibit neutralizing activity against HIV-1 strain JR-CSF, but not against strain SF162. 1443_C16 (PG16) and 1496_C09 (PG9) also were found to lack gp41 binding activity in the ELISA assay.

The epitopes recognized by these antibodies may have a number of uses. The epitopes and mimotopes in purified or synthetic form can be used to raise immune responses (i.e. as a vaccine, or for the production of antibodies for other uses) or for screening patient serum for antibodies that immunoreact with the epitopes or mimotopes. Preferably, such an epitope or mimotope, or antigen comprising such an epitope or mimotope is used as a vaccine for raising an immune response. The antibodies of the invention can also be used in a method to monitor the quality of vaccines in particular to check that the antigen in a vaccine contains the correct immunogenic epitope in the correct conformation.

The epitopes may also be useful in screening for ligands that bind to said epitopes. Such ligands preferably block the epitopes and thus prevent infection. Such ligands are encompassed within the scope of the invention.

Standard techniques of molecular biology may be used to prepare DNA sequences coding for the antibodies or fragments of the antibodies of the present invention. Desired DNA sequences may be synthesized completely or in part using oligonucleotide synthesis techniques. Site-directed mutagenesis and polymerase chain reaction (PCR) techniques may be used as appropriate.

Any suitable host cell/vector system may be used for expression of the DNA sequences encoding the antibody molecules of the present invention or fragments thereof. Bacterial, for example E. coli, and other microbial systems may be used, in part, for expression of antibody fragments such as Fab and F(ab')$_2$ fragments, and especially Fv fragments and single chain antibody fragments, for example, single chain Fvs. Eukaryotic, e.g. mammalian, host cell expression systems may be used for production of larger antibody molecules, including complete antibody molecules. Suitable mammalian host cells include CHO, HEK293T, PER.C6, myeloma or hybridoma cells.

The present invention also provides a process for the production of an antibody molecule according to the present invention comprising culturing a host cell comprising a vector of the present invention under conditions suitable for leading to expression of protein from DNA encoding the antibody molecule of the present invention, and isolating the antibody molecule. The antibody molecule may comprise only a heavy or light chain polypeptide, in which case only a heavy chain or light chain polypeptide coding sequence needs to be used to transfect the host cells. For production of products comprising both heavy and light chains, the cell line may be transfected with two vectors, a first vector encoding a light chain polypeptide and a second vector encoding a heavy chain polypeptide. Alternatively, a single vector may be used, the vector including sequences encoding light chain and heavy chain polypeptides.

Alternatively, antibodies according to the invention may be produced by i) expressing a nucleic acid sequence according to the invention in a cell, and ii) isolating the expressed antibody product. Additionally, the method may include iii) purifying the antibody. Transformed B cells are screened for those producing antibodies of the desired antigen specificity, and individual B cell clones can then be produced from the positive cells. The screening step may be carried out by ELISA, by staining of tissues or cells (including transfected cells), a neutralization assay or one of a number of other methods known in the art for identifying desired antigen specificity. The assay may select on the basis of simple antigen recognition, or may select on the additional basis of a desired function e.g. to select neutralizing antibodies rather than just antigen-binding antibodies, to select antibodies that can change characteristics of targeted cells, such as their signaling cascades, their shape, their growth rate, their capability of influencing other cells, their response to the influence by other cells or by other reagents or by a change in conditions, their differentiation status, etc.

The cloning step for separating individual clones from the mixture of positive cells may be carried out using limiting dilution, micromanipulation, single cell deposition by cell sorting or another method known in the art. Preferably the cloning is carried out using limiting dilution.

The immortalized B cell clones of the invention can be used in various ways e.g. as a source of monoclonal antibodies, as a source of nucleic acid (DNA or mRNA) encoding a monoclonal antibody of interest, for research, etc.

Unless otherwise defined, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization described herein are those well known and commonly used in the art. Standard techniques are used for recombinant DNA, oligonucleotide synthesis, and tissue culture and transformation (e.g., electroporation, lipofection). Enzymatic reactions and purification techniques are performed according to manufacturer's specifications or as commonly accomplished in the art or as described herein. The practice of the present invention will employ, unless indicated specifically to the contrary, conventional methods of virology, immunology, microbiology, molecular biology and recombinant DNA techniques within the skill of the art, many of which are described below for the purpose of illustration. Such techniques are explained fully in the literature. See, e.g., Sambrook, et al. Molecular Cloning: A Laboratory Manual (2nd Edition, 1989); Maniatis et al. Molecular Cloning: A Laboratory Manual (1982); DNA Cloning: A Practical Approach, vol. I & II (D. Glover, ed.); Oligonucleotide Synthesis (N. Gait, ed., 1984); Nucleic Acid Hybridization (B. Hames & S. Higgins, eds., 1985); Transcription and Translation (B. Hames & S. Higgins, eds., 1984); Animal Cell Culture (R. Freshney, ed., 1986); Perbal, A Practical Guide to Molecular Cloning (1984). The nomenclatures utilized in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

The following definitions are useful in understanding the present invention: The term "antibody" (Ab) as used herein includes monoclonal antibodies, polyclonal antibodies, multispecific antibodies (e.g., bispecific antibodies), and antibody fragments, as long as they exhibit the desired biological activity. The term "immunoglobulin" (Ig) is used interchangeably with "antibody" herein.

A "neutralizing antibody" may inhibit the entry of HIV-1 virus for example SF162 and/or JR-CSF with a neutralization index >1.5 or >2.0. (Kostrikis L G et al. J Virol. 1996; 70(1): 445-458.) By "broad and potent neutralizing antibodies" are meant antibodies that neutralize more than one HIV-1 virus species (from diverse clades and different strains within a clade) in a neutralization assay. A broad neutralizing antibody may neutralize at least 2, 3, 4, 5, 6, 7, 8, 9 or more different strains of HIV-1, the strains belonging to the same or different clades. A broad neutralizing antibody may neutralize multiple HIV-1 species belonging to at least 2, 3, 4, 5, or 6 different clades. The inhibitory concentration of the monoclonal antibody may be less than about 25 mg/ml to neutralize about 50% of the input virus in the neutralization assay.

An "isolated antibody" is one that has been separated and/or recovered from a component of its natural environment. Contaminant components of its natural environment are materials that would interfere with diagnostic or therapeutic uses for the antibody, and may include enzymes, hormones, and other proteinaceous or nonproteinaceous solutes. In preferred embodiments, the antibody is purified: (1) to greater than 95% by weight of antibody as determined by the Lowry method, and most preferably more than 99% by weight; (2) to a degree sufficient to obtain at least 15 residues of N-terminal or internal amino acid sequence by use of a spinning cup sequenator; or (3) to homogeneity by SDS-PAGE under reducing or non-reducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The basic four-chain antibody unit is a heterotetrameric glycoprotein composed of two identical light (L) chains and two identical heavy (H) chains. An IgM antibody consists of 5 basic heterotetramer units along with an additional polypeptide called J chain, and therefore contain 10 antigen binding sites, while secreted IgA antibodies can polymerize to form polyvalent assemblages comprising 2-5 of the basic 4-chain units along with J chain. In the case of IgGs, the 4-chain unit is generally about 150,000 daltons. Each L chain is linked to an H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable region ($V_H$) followed by three constant domains ($C_H$) for each of the α and γ chains and four $C_H$ domains for μ and ε isotypes. Each L chain has at the N-terminus, a variable region ($V_L$) followed by a constant domain ($C_L$) at its other end. The $V_L$ is aligned with the $V_H$ and the $C_L$ is aligned with the first constant domain of the heavy chain ($C_H1$). Particular amino acid residues are believed to form an interface between the light chain and heavy chain variable regions. The pairing of a $V_H$ and $V_L$ together forms a single antigen-binding site. For the structure and properties of the different classes of antibodies, see, e.g., Basic and Clinical Immunology, 8th edition, Daniel P. Stites, Abba I. Terr and Tristram G. Parslow (eds.), Appleton & Lange, Norwalk, Conn., 1994, page 71, and Chapter 6.

The L chain from any vertebrate species can be assigned to one of two clearly distinct types, called kappa (κ) and lambda (λ), based on the amino acid sequences of their constant domains (CO. Depending on the amino acid sequence of the constant domain of their heavy chains ($C_H$), immunoglobulins can be assigned to different classes or isotypes. There are five classes of immunoglobulins: IgA, IgD, IgE, IgG, and IgM, having heavy chains designated alpha (a), delta (δ, epsilon (ε), gamma (γ) and mu (μ, respectively. The γ and α classes are further divided into subclasses on the basis of relatively minor differences in $C_H$ sequence and function, e.g., humans express the following subclasses: $IgG_1$, $IgG_2$, $IgG_3$, $IgG_4$, $IgA_1$, and $IgA_2$.

The term "variable" refers to the fact that certain segments of the V domains differ extensively in sequence among antibodies. The V domain mediates antigen binding and defines specificity of a particular antibody for its particular antigen. However, the variability is not evenly distributed across the 110-amino acid span of the variable regions. Instead, the V regions consist of relatively invariant stretches called framework regions (FRs) of 15-30 amino acids separated by shorter regions of extreme variability called "hypervariable regions" that are each 9-12 amino acids long. The variable regions of native heavy and light chains each comprise four FRs, largely adopting a β-sheet configuration, connected by three hypervariable regions, which form loops connecting, and in some cases forming part of, the β-sheet structure. The hypervariable regions in each chain are held together in close proximity by the FRs and, with the hypervariable regions from the other chain, contribute to the formation of the antigen-binding site of antibodies (see Kabat et al., Sequences of Proteins of Immunological Interest, 5th Ed. Public Health Service, National Institutes of Health, Bethesda, Md. (1991)). The constant domains are not involved directly in binding an antibody to an antigen, but exhibit various effector functions, such as participation of the antibody in antibody dependent cellular cytotoxicity (ADCC).

The term "hypervariable region" when used herein refers to the amino acid residues of an antibody that are responsible for antigen binding. The hypervariable region generally comprises amino acid residues from a "complementarity determining region" or "CDR" (e.g., around about residues 24-34 (L1), 50-56 (L2) and 89-97 (L3) in the $V_L$, and around about 31-35 (H1), 50-65 (H2) and 95-102 (H3) in the $V_H$ when numbered in accordance with the Kabat numbering system; Kabat et al., Sequences of Proteins of Immunological Interest, 5th Ed. Public Health Service, National Institutes of Health, Bethesda, Md. (1991)); and/or those residues from a "hypervariable loop" (e.g., residues 24-34 (L1), 50-56 (L2) and 89-97 (L3) in the $V_L$, and 26-32 (H1), 52-56 (H2) and 95-101 (H3) in the $V_H$ when numbered in accordance with the Chothia numbering system; Chothia and Lesk, J. Mol. Biol. 196:901-917 (1987)); and/or those residues from a "hypervariable loop"/CDR (e.g., residues 27-38 (L1), 56-65 (L2) and 105-120 (L3) in the $V_L$, and 27-38 (H1), 56-65. (H2) and 105-120 (H3) in the $V_H$ when numbered in accordance with the IMGT numbering system; Lefranc, M. P. et al. Nucl. Acids Res. 27:209-212 (1999), Ruiz, M. e al. Nucl. Acids Res. 28:219-221 (2000)). Optionally the antibody has symmetrical insertions at one or more of the following points 28, 36 (L1), 63, 74-75 (L2) and 123 (L3) in the $V_L$, and 28, 36 (H1), 63, 74-75 (H2) and 123 (H3) in the $V_H$ when numbered in accordance with AHo; Honneger, A. and Plunkthun, A. J. Mol. Biol. 309:657-670 (2001)).

By "germline nucleic acid residue" is meant the nucleic acid residue that naturally occurs in a germline gene encoding a constant or variable region. "Germline gene" is the DNA found in a germ cell (i.e., a cell destined to become an egg or in the sperm). A "germline mutation" refers to a heritable change in a particular DNA that has occurred in a germ cell or the zygote at the single-cell stage, and when transmitted to offspring, such a mutation is incorporated in every cell of the body. A germline mutation is in contrast to a somatic mutation which is acquired in a single body cell. In some cases, nucleotides in a germline DNA sequence encoding for a variable region are mutated (i.e., a somatic mutation) and replaced with a different nucleotide.

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to polyclonal antibody preparations that include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" is not to be construed as requiring production of the antibody by any particular method. For example, the monoclonal antibodies useful in the present invention may be prepared by the hybridoma methodology first described by Kohler et al., Nature, 256:495 (1975), or may be made using recombinant DNA methods in bacterial, eukaryotic animal or plant cells (see, e.g., U.S. Pat. No. 4,816,567). The "monoclonal antibodies" may also be isolated from phage antibody libraries using the techniques described in Clackson et al., Nature, 352:624-628 (1991) and Marks et al., J. Mol. Biol., 222: 581-597 (1991), for example.

In some aspects, the alternative EBV immortalization method described in WO2004/076677 is used. Using this method, B-cells producing the antibody of the invention can be transformed with EBV in the presence of a polyclonal B cell activator. Transformation with EBV is a standard technique and can easily be adapted to include polyclonal B cell activators. Additional stimulants of cellular growth and differentiation may be added during the transformation step to further enhance the efficiency. These stimulants may be cytokines such as IL-2 and IL-15. In a particularly preferred aspect, IL-2 is added during the immortalization step to further improve the efficiency of immortalization, but its use is not essential.

The monoclonal antibodies herein include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see U.S. Pat. No. 4,816,567; and Morrison et al., Proc. Natl. Acad. Sci. USA, 81:6851-6855 (1984)). The present invention provides variable region antigen-binding sequences derived from human antibodies. Accordingly, chimeric antibodies of primary interest herein include antibodies having one or more human antigen binding sequences (e.g., CDRs) and containing one or more sequences derived from a non-human antibody, e.g., an FR or C region sequence. In addition, chimeric antibodies of primary interest herein include those comprising a human variable region antigen binding sequence of one antibody class or subclass and another sequence, e.g., FR or C region sequence, derived from another antibody class or subclass. Chimeric antibodies of interest herein also include those containing variable region antigen-binding sequences related to those described herein or derived from a different species, such as a non-human primate (e.g., Old World Monkey, Ape, etc). Chimeric antibodies also include primatized and humanized antibodies.

Furthermore, chimeric antibodies may comprise residues that are not found in the recipient antibody or in the donor antibody. These modifications are made to further refine antibody performance. For further details, see Jones et al., Nature 321:522-525 (1986); Riechmann et al., Nature 332: 323-329 (1988); and Presta, Curr. Op. Struct. Biol. 2:593-596 (1992).

A "humanized antibody" is generally considered to be a human antibody that has one or more amino acid residues introduced into it from a source that is non-human. These non-human amino acid residues are often referred to as "import" residues, which are typically taken from an "import" variable region. Humanization is traditionally performed following the method of Winter and co-workers (Jones et al., Nature, 321:522-525 (1986); Reichmann et al., Nature, 332:323-327 (1988); Verhoeyen et al., Science, 239:1534-1536 (1988)), by substituting import hypervariable region sequences for the corresponding sequences of a human antibody. Accordingly, such "humanized" antibodies are chimeric antibodies (U.S. Pat. No. 4,816,567), wherein substantially less than an intact human variable region has been substituted by the corresponding sequence from a non-human species.

A "human antibody" is an antibody containing only sequences present in an antibody naturally produced by a human. However, as used herein, human antibodies may comprise residues or modifications not found in a naturally occurring human antibody, including those modifications and variant sequences described herein. These are typically made to further refine or enhance antibody performance.

An "intact" antibody is one that comprises an antigen-binding site as well as a $C_L$ and at least heavy chain constant domains, $C_H1$, $C_H2$ and $C_H3$. The constant domains may be native sequence constant domains (e.g., human native sequence constant domains) or amino acid sequence variant thereof. Preferably, the intact antibody has one or more effector functions.

An "antibody fragment" comprises a portion of an intact antibody, preferably the antigen binding or variable region of the intact antibody. Examples of antibody fragments include Fab, Fab', F(ab')2, and Fv fragments; diabodies; linear antibodies (see U.S. Pat. No. 5,641,870; Zapata et al., Protein Eng. 8(10): 1057-1062 [1995]); single-chain antibody molecules; and multispecific antibodies formed from antibody fragments.

The phrase "functional fragment or analog" of an antibody is a compound having qualitative biological activity in common with a full-length antibody. For example, a functional fragment or analog of an anti-IgE antibody is one that can bind to an IgE immunoglobulin in such a manner so as to prevent or substantially reduce the ability of such molecule from having the ability to bind to the high affinity receptor, Fc Papain digestion of antibodies produces two identical antigen-binding fragments, called "Fab" fragments, and a residual "Fc" fragment, a designation reflecting the ability to crystallize readily. The Fab fragment consists of an entire L chain along with the variable region domain of the H chain ($V_H$), and the first constant domain of one heavy chain ($C_H 1$). Each Fab fragment is monovalent with respect to antigen binding, i.e., it has a single antigen-binding site. Pepsin treatment of an antibody yields a single large $F(ab')_2$ fragment that roughly corresponds to two disulfide linked Fab fragments having divalent antigen-binding activity and is still capable of cross-linking antigen. Fab' fragments differ from Fab fragments by having additional few residues at the carboxy terminus of the $C_H 1$ domain including one or more cysteines from the antibody hinge region. Fab'-SH is the designation herein for Fab' in which the cysteine residue(s) of the constant domains bear a free thiol group. $F(ab')_2$ antibody fragments originally were produced as pairs of Fab' fragments that have hinge cysteines between them. Other chemical couplings of antibody fragments are also known.

The "Fc" fragment comprises the carboxy-terminal portions of both H chains held together by disulfides. The effector functions of antibodies are determined by sequences in the Fc region, which region is also the part recognized by Fc receptors (FcR) found on certain types of cells.

"Fv" is the minimum antibody fragment that contains a complete antigen-recognition and -binding site. This fragment consists of a dimer of one heavy- and one light-chain variable region domain in tight, non-covalent association. From the folding of these two domains emanate six hypervariable loops (three loops each from the H and L chain) that contribute the amino acid residues for antigen binding and confer antigen binding specificity to the antibody. However, even a single variable region (or half of an Fv comprising only three CDRs specific for an antigen) has the ability to recognize and bind antigen, although at a lower affinity than the entire binding site.

"Single-chain Fv" also abbreviated as "sFv" or "scFv" are antibody fragments that comprise the $V_H$ and $V_L$ antibody domains connected into a single polypeptide chain. Preferably, the sFv polypeptide further comprises a polypeptide linker between the $V_H$ and $V_L$ domains that enables the sFv to form the desired structure for antigen binding. For a review of sFv, see Pluckthun in The Pharmacology of Monoclonal Antibodies, vol. 113, Rosenburg and Moore eds., Springer-Verlag, New York, pp. 269-315 (1994); Borrebaeck 1995, infra.

The term "diabodies" refers to small antibody fragments prepared by constructing sFv fragments (see preceding paragraph) with short linkers (about 5-10 residues) between the NTH and $V_L$ domains such that inter-chain but not intra-chain pairing of the V domains is achieved, resulting in a bivalent fragment, i.e., fragment having two antigen-binding sites. Bispecific diabodies are heterodimers of two "crossover" sFv fragments in which the $V_H$ and $V_L$ domains of the two antibodies are present on different polypeptide chains. Diabodies are described more fully in, for example, EP 404,097; WO 93/11161; and Hollinger et al., Proc. Natl. Acad. Sci. USA, 90:6444-6448 (1993).

Domain antibodies (dAbs), which can be produced in fully human form, are the smallest known antigen-binding fragments of antibodies, ranging from 11 kDa to 15 kDa. dAbs are the robust variable regions of the heavy and light chains of immunoglobulins (VH and VL respectively). They are highly expressed in microbial cell culture, show favourable biophysical properties including solubility and temperature stability, and are well suited to selection and affinity maturation by in vitro selection systems such as phage display. dAbs are bioactive as monomers and, owing to their small size and inherent stability, can be formatted into larger molecules to create drugs with prolonged serum half-lives or other pharmacological activities. Examples of this technology have been described in WO9425591 for antibodies derived from Camelidae heavy chain Ig, as well in US20030130496 describing the isolation of single domain fully human antibodies from phage libraries.

As used herein, an antibody that "internalizes" is one that is taken up by (i.e., enters) the cell upon binding to an antigen on a mammalian cell (e.g., a cell surface polypeptide or receptor). The internalizing antibody will of course include antibody fragments, human or chimeric antibody, and antibody conjugates. For certain therapeutic applications, internalization in vivo is contemplated. The number of antibody molecules internalized will be sufficient or adequate to kill a cell or inhibit its growth, especially an infected cell. Depending on the potency of the antibody or antibody conjugate, in some instances, the uptake of a single antibody molecule into the cell is sufficient to kill the target cell to which the antibody binds. For example, certain toxins are highly potent in killing such that internalization of one molecule of the toxin conjugated to the antibody is sufficient to kill the infected cell.

As used herein, an antibody is said to be "immunospecific," "specific for" or to "specifically bind" an antigen if it reacts at a detectable level with the antigen, preferably with an affinity constant, $K_a$, of greater than or equal to about $10^{-4}$ $M^{-1}$, or greater than or equal to about $10^5$ $M^{-1}$, greater than or equal to about $10^6$ $M^{-1}$, greater than or equal to about $10^7$ $M^{-1}$, or greater than or equal to $10^8$ $M^{-1}$. Affinity of an antibody for its cognate antigen is also commonly expressed as a dissociation constant $K_D$, and in certain embodiments, HIV1 antibody specifically binds to an HIV1 polypeptide if it binds with a $K_D$ of less than or equal to $10^{-4}$ M, less than or equal to about $10^{-5}$ M, less than or equal to about $10^{-6}$ M, less than or equal to $10^{-7}$ M, or less than or equal to $10^{-8}$ M. Affinities of antibodies can be readily determined using conventional techniques, for example, those described by Scatchard et al. (Ann. N.Y. Acad. Sci. USA 51:660 (1949)).

Binding properties of an antibody to antigens, cells or tissues thereof may generally be determined and assessed using immunodetection methods including, for example, immunofluorescence-based assays, such as immuno-histochemistry (IHC) and/or fluorescence-activated cell sorting (FACS).

An antibody having a "biological characteristic" of a designated antibody is one that possesses one or more of the biological characteristics of that antibody which distinguish it from other antibodies. For example, in certain embodiments, an antibody with a biological characteristic of a designated antibody will bind the same epitope as that bound by the designated antibody and/or have a common effector function as the designated antibody.

The term "antagonist" antibody is used in the broadest sense, and includes an antibody that partially or fully blocks, inhibits, or neutralizes a biological activity of an epitope, polypeptide, or cell that it specifically binds. Methods for identifying antagonist antibodies may comprise contacting a polypeptide or cell specifically bound by a candidate antagonist antibody with the candidate antagonist antibody and measuring a detectable change in one or more biological activities normally associated with the polypeptide or cell.

An "antibody that inhibits the growth of infected cells" or a "growth inhibitory" antibody is one that binds to and results in measurable growth inhibition of infected cells expressing or capable of expressing an HIV1 epitope bound by an antibody. Preferred growth inhibitory antibodies inhibit growth of infected cells by greater than 20%, preferably from about 20% to about 50%, and even more preferably, by greater than 50% (e.g., from about 50% to about 100%) as compared to the appropriate control, the control typically being infected cells not treated with the antibody being tested. Growth inhibition can be measured at an antibody concentration of about 0.1 to 30 µg/ml or about 0.5 nM to 200 nM in cell culture, where the growth inhibition is determined 1-10 days after exposure of the infected cells to the antibody. Growth inhibition of infected cells in vivo can be determined in various ways known in the art.

The antibody is growth inhibitory in vivo if administration of the antibody at about 1 µg/kg to about 100 mg/kg body weight results in reduction the percent of infected cells or total number of infected cells within about 5 days to 3 months from the first administration of the antibody, preferably within about 5 to 30 days.

An antibody that "induces apoptosis" is one which induces programmed cell death as determined by binding of annexin V, fragmentation of DNA, cell shrinkage, dilation of endoplasmic reticulum, cell fragmentation, and/or formation of membrane vesicles (called apoptotic bodies). Preferably the cell is an infected cell. Various methods are available for evaluating the cellular events associated with apoptosis. For example, phosphatidyl serine (PS) translocation can be measured by annexin binding; DNA fragmentation can be evaluated through DNA laddering; and nuclear/chromatin condensation along with DNA fragmentation can be evaluated by any increase in hypodiploid cells. Preferably, the antibody that induces apoptosis is one that results in about 2 to 50 fold, preferably about 5 to 50 fold, and most preferably about 10 to 50 fold, induction of annexin binding relative to untreated cell in an annexin binding assay.

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC); phagocytosis; down regulation of cell surface receptors (e.g., B cell receptor); and B cell activation.

"Antibody-dependent cell-mediated cytotoxicity" or "ADCC" refers to a form of cytotoxicity in which secreted Ig bound to Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are required for such killing. The primary cells for mediating ADCC, NK cells, express FcγRIII only, whereas monocytes express FcγRI, FcγRII and FcγRIII. FcR expression on hematopoietic cells is summarized in Table 4 on page 464 of Ravetch and Kinet, Annu. Rev. Immunol 9:457-92 (1991). To assess ADCC activity of a molecule of interest, an in vitro ADCC assay, such as that described in U.S. Pat. No. 5,500,362 or 5,821,337 may be performed. Useful effector cells for such assays include peripheral blood mononuclear cells (PBMC) and Natural Killer (NK) cells.

Alternatively, or additionally, ADCC activity of the molecule of interest may be assessed in vivo, e.g., in a animal model such as that disclosed in Clynes et al., Proc. Natl. Acad. Sci. (USA) 95:652-656 (1998).

"Fc receptor" or "FcR" describes a receptor that binds to the Fc region of an antibody. In certain embodiments, the FcR is a native sequence human FcR. Moreover, a preferred FcR is one that binds an IgG antibody (a gamma receptor) and includes receptors of the FcγRI, FcγRII, and FcγRIII subclasses, including allelic variants and alternatively spliced forms of these receptors. FCγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (see review M. in Daeron, Annu. Rev. Immunol. 15:203-234 (1997)). FcRs are reviewed in Ravetch and Kinet, Annu. Rev. Immunol 9:457-92 (1991); Capel et al., Immunomethods 4:25-34 (1994); and de Haas et al., J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., J. Immunol. 117:587 (1976) and Kim et al., J. Immunol. 24:249 (1994)).

"Human effector cells" are leukocytes that express one or more FcRs and perform effector functions. Preferably, the cells express at least FcγRIII and perform ADCC effector function. Examples of human leukocytes that mediate ADCC include PBMC, NK cells, monocytes, cytotoxic T cells and neutrophils; with PBMCs and NK cells being preferred. The effector cells may be isolated from a native source, e.g., from blood.

"Complement dependent cytotoxicity" or "CDC" refers to the lysis of a target cell in the presence of complement. Activation of the classical complement pathway is initiated by the binding of the first component of the complement system (Clq) to antibodies (of the appropriate subclass) that are bound to their cognate antigen. To assess complement activation, a CDC assay, e.g., as described in Gazzano-Santoro et al., J. Immunol. Methods 202:163 (1996), may be performed.

A "mammal" for purposes of treating an infection, refers to any mammal, including humans, domestic and farm animals, and zoo, sports, or pet animals, such as dogs, cats, cattle, horses, sheep, pigs, goats, rabbits, etc. Preferably, the mammal is human.

"Treating" or "treatment" or "alleviation" refers to both therapeutic treatment and prophylactic or preventative measures; wherein the object is to prevent or slow down (lessen) the targeted pathologic condition or disorder. Those in need of treatment include those already with the disorder as well as those prone to have the disorder or those in whom the disorder is to be prevented. A subject or mammal is successfully "treated" for an infection if, after receiving a therapeutic amount of an antibody according to the methods of the present invention, the patient shows observable and/or measurable reduction in or absence of one or more of the following: reduction in the number of infected cells or absence of the infected cells; reduction in the percent of total cells that are infected; and/or relief to some extent, one or more of the symptoms associated with the specific infection; reduced morbidity and mortality, and improvement in quality of life issues. The above parameters for assessing successful treatment and improvement in the disease are readily measurable by routine procedures familiar to a physician.

The term "therapeutically effective amount" refers to an amount of an antibody or a drug effective to "treat" a disease or disorder in a subject or mammal. See preceding definition of "treating."

"Chronic" administration refers to administration of the agent(s) in a continuous mode as opposed to an acute mode, so as to maintain the initial therapeutic effect (activity) for an extended period of time. "Intermittent" administration is treatment that is not consecutively done without interruption, but rather is cyclic in nature.

Administration "in combination with" one or more further therapeutic agents includes simultaneous (concurrent) and consecutive administration in any order.

"Carriers" as used herein include pharmaceutically acceptable carriers, excipients, or stabilizers that are nontoxic to the cell or mammal being exposed thereto at the dosages and concentrations employed. Often the physiologically acceptable carrier is an aqueous pH buffered solution. Examples of physiologically acceptable carriers include buffers such as phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™ polyethylene glycol (PEG), and PLURONICS™.

The term "cytotoxic agent" as used herein refers to a substance that inhibits or prevents the function of cells and/or causes destruction of cells. The term is intended to include radioactive isotopes (e.g., $At^{211}$, $I^{113}$, $I^{125}$, $Y^{90}$, $Re^{186}$, $Re^{188}$, $Sm^{153}$, $Bi^{212}$, $P^{32}$ and radioactive isotopes of Lu), chemotherapeutic agents e.g., methotrexate, adriamicin, *vinca* alkaloids (vincristine, vinblastine, etoposide), doxorubicin, melphalan, mitomycin C, chlorambucil, daunorubicin or other intercalating agents, enzymes and fragments thereof such as nucleolytic enzymes, antibiotics, and toxins such as small molecule toxins or enzymatically active toxins of bacterial, fungal, plant or animal origin, including fragments and/or variants thereof, and the various antitumor or anticancer agents disclosed below. Other cytotoxic agents are described below.

A "growth inhibitory agent" when used herein refers to a compound or composition which inhibits growth of a cell, either in vitro or in vivo. Examples of growth inhibitory agents include agents that block cell cycle progression, such as agents that induce G1 arrest and M-phase arrest. Classical M-phase blockers include the *vinca* alkaloids (vincristine, vinorelbine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in The Molecular Basis of Cancer, Mendelsohn and Israel, eds., Chapter 1, entitled "Cell cycle regulation, oncogenes, and antineoplastic drugs" by Murakami et al. (W B Saunders: Philadelphia, 1995), especially p. 13. The taxanes (paclitaxel and docetaxel) are anticancer drugs both derived from the yew tree. Docetaxel (TAXOTERE™, Rhone-Poulenc Rorer), derived from the European yew, is a semisynthetic analogue of paclitaxel (TAXOL®, Bristol-Myers Squibb). Paclitaxel and docetaxel promote the assembly of microtubules from tubulin dimers and stabilize microtubules by preventing depolymerization, which results in the inhibition of mitosis in cells.

"Label" as used herein refers to a detectable compound or composition that is conjugated directly or indirectly to the antibody so as to generate a "labeled" antibody. The label may be detectable by itself (e.g., radioisotope labels or fluorescent labels) or, in the case of an enzymatic label, may catalyze chemical alteration of a substrate compound or composition that is detectable.

The term "epitope tagged" as used herein refers to a chimeric polypeptide comprising a polypeptide fused to a "tag polypeptide." The tag polypeptide has enough residues to provide an epitope against which an antibody can be made, yet is short enough such that it does not interfere with activity of the polypeptide to which it is fused. The tag polypeptide is also preferably fairly unique so that the antibody does not substantially cross-react with other epitopes. Suitable tag polypeptides generally have at least six amino acid residues and usually between about 8 and 50 amino acid residues (preferably, between about 10 and 20 amino acid residues).

A "small molecule" is defined herein to have a molecular weight below about 500 Daltons.

The terms "nucleic acid" and "polynucleotide" are used interchangeably herein to refer to single- or double-stranded RNA, DNA, or mixed polymers. Polynucleotides may include genomic sequences, extra-genomic and plasmid sequences, and smaller engineered gene segments that express, or may be adapted to express polypeptides.

An "isolated nucleic acid" is a nucleic acid that is substantially separated from other genome DNA sequences as well as proteins or complexes such as ribosomes and polymerases, which naturally accompany a native sequence. The term embraces a nucleic acid sequence that has been removed from its naturally occurring environment, and includes recombinant or cloned DNA isolates and chemically synthesized analogues or analogues biologically synthesized by heterologous systems. A substantially pure nucleic acid includes isolated forms of the nucleic acid. Of course, this refers to the nucleic acid as originally isolated and does not exclude genes or sequences later added to the isolated nucleic acid by the hand of man.

The term "polypeptide" is used in its conventional meaning, i.e., as a sequence of amino acids. The polypeptides are not limited to a specific length of the product. Peptides, oligopeptides, and proteins are included within the definition of polypeptide, and such terms may be used interchangeably herein unless specifically indicated otherwise. This term also does not refer to or exclude post-expression modifications of the polypeptide, for example, glycosylations, acetylations, phosphorylations and the like, as well as other modifications known in the art, both naturally occurring and non-naturally occurring. A polypeptide may be an entire protein, or a subsequence thereof. Particular polypeptides of interest in the context of this invention are amino acid subsequences comprising CDRs and being capable of binding an antigen or HIV-infected cell.

An "isolated polypeptide" is one that has been identified and separated and/or recovered from a component of its natural environment. In preferred embodiments, the isolated polypeptide will be purified (1) to greater than 95% by weight of polypeptide as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or non-reducing conditions using Coomassie blue or, preferably, silver stain. Isolated polypeptide includes the polypeptide in situ within recombinant cells since at least one component of the polypeptide's natural environment will not be present. Ordinarily, however, isolated polypeptide will be prepared by at least one purification step.

A "native sequence" polynucleotide is one that has the same nucleotide sequence as a polynucleotide derived from nature. A "native sequence" polypeptide is one that has the same amino acid sequence as a polypeptide (e.g., antibody) derived from nature (e.g., from any species). Such native sequence polynucleotides and polypeptides can be isolated from nature or can be produced by recombinant or synthetic means.

A polynucleotide "variant," as the term is used herein, is a polynucleotide that typically differs from a polynucleotide specifically disclosed herein in one or more substitutions, deletions, additions and/or insertions. Such variants may be naturally occurring or may be synthetically generated, for example, by modifying one or more of the polynucleotide sequences of the invention and evaluating one or more biological activities of the encoded polypeptide as described herein and/or using any of a number of techniques well known in the art.

A polypeptide "variant," as the term is used herein, is a polypeptide that typically differs from a polypeptide specifically disclosed herein in one or more substitutions, deletions, additions and/or insertions. Such variants may be naturally occurring or may be synthetically generated, for example, by modifying one or more of the above polypeptide sequences of the invention and evaluating one or more biological activities of the polypeptide as described herein and/or using any of a number of techniques well known in the art.

Modifications may be made in the structure of the polynucleotides and polypeptides of the present invention and still obtain a functional molecule that encodes a variant or derivative polypeptide with desirable characteristics. When it is desired to alter the amino acid sequence of a polypeptide to create an equivalent, or even an improved, variant or portion of a polypeptide of the invention, one skilled in the art will typically change one or more of the codons of the encoding DNA sequence.

For example, certain amino acids may be substituted for other amino acids in a protein structure without appreciable loss of its ability to bind other polypeptides (e.g., antigens) or cells. Since it is the binding capacity and nature of a protein that defines that protein's biological functional activity, certain amino acid sequence substitutions can be made in a protein sequence, and, of course, it's underlying DNA coding sequence, and nevertheless obtain a protein with like properties. It is thus contemplated that various changes may be made in the peptide sequences of the disclosed compositions, or corresponding DNA sequences that encode said peptides without appreciable loss of their biological utility or activity.

In many instances, a polypeptide variant will contain one or more conservative substitutions. A "conservative substitution" is one in which an amino acid is substituted for another amino acid that has similar properties, such that one skilled in the art of peptide chemistry would expect the secondary structure and hydropathic nature of the polypeptide to be substantially unchanged.

In making such changes, the hydropathic index of amino acids may be considered. The importance of the hydropathic amino acid index in conferring interactive biologic function on a protein is generally understood in the art (Kyte and Doolittle, 1982). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein. In making such changes, the substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity. U.S. Pat. No. 4,554,101 states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent protein. In such changes, the substitution of amino acids whose hydrophilicity values are within ±2 is preferred, those within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include: arginine and lysine; glutamate and aspartate; serine and threonine; glutamine and asparagine; and valine, leucine and isoleucine.

Amino acid substitutions may further be made on the basis of similarity in polarity, charge, solubility, hydrophobicity, hydrophilicity and/or the amphipathic nature of the residues. For example, negatively charged amino acids include aspartic acid and glutamic acid; positively charged amino acids include lysine and arginine; and amino acids with uncharged polar head groups having similar hydrophilicity values include leucine, isoleucine and valine; glycine and alanine; asparagine and glutamine; and serine, threonine, phenylalanine and tyrosine. Other groups of amino acids that may represent conservative changes include: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. A variant may also, or alternatively, contain nonconservative changes. In a preferred embodiment, variant polypeptides differ from a native sequence by substitution, deletion or addition of five amino acids or fewer. Variants may also (or alternatively) be modified by, for example, the deletion or addition of amino acids that have minimal influence on the immunogenicity, secondary structure and hydropathic nature of the polypeptide.

Polypeptides may comprise a signal (or leader) sequence at the N-terminal end of the protein, which co-translationally or post-translationally directs transfer of the protein. The polypeptide may also be conjugated to a linker or other sequence for ease of synthesis, purification or identification of the polypeptide (e.g., poly-His), or to enhance binding of the polypeptide to a solid support. For example, a polypeptide may be conjugated to an immunoglobulin Fc region.

When comparing polynucleotide and polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J. (1990)

Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E. W. and Muller W. (1988) *CABIOS* 4:11-17; Robinson, E. D. (1971) Comb. Theor 11:105; Santou, N. Nes, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

One preferred example of algorithms that are suitable for determining percent sequence identity and sequence similarity are the BLAST and BLAST 2.0 algorithms, which are described in Altschul et al. (1977) Nucl. Acids Res. 25:3389-3402 and Altschul et al. (1990) *J. Mol. Biol.* 215:403-410, respectively. BLAST and BLAST 2.0 can be used, for example with the parameters described herein, to determine percent sequence identity for the polynucleotides and polypeptides of the invention. Software for performing BLAST analyses is publicly available through the National Center for Biotechnology Information.

In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, and expectation (E) of 10, and the BLOSUM62 scoring matrix (see Henikoff and Henikoff (1989) *Proc. Natl. Acad. Sci. USA* 89:10915) alignments, (B) of 50, expectation (E) of 10, M=5, N=−4 and a comparison of both strands.

For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment.

In one approach, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residues occur in both sequences to yield the number of matched positions, dividing the number of matched positions by the total number of positions in the reference sequence (i.e., the window size) and multiplying the results by 100 to yield the percentage of sequence identity.

"Homology" refers to the percentage of residues in the polynucleotide or polypeptide sequence variant that are identical to the non-variant sequence after aligning the sequences and introducing gaps, if necessary, to achieve the maximum percent homology. In particular embodiments, polynucleotide and polypeptide variants have at least 70%, at least 75%, at least 80%, at least 90%, at least 95%, at least 98%, or at least 99% polynucleotide or polypeptide homology with a polynucleotide or polypeptide described herein.

"Vector" includes shuttle and expression vectors. Typically, the plasmid construct will also include an origin of replication (e.g., the ColE1 origin of replication) and a selectable marker (e.g., ampicillin or tetracycline resistance), for replication and selection, respectively, of the plasmids in bacteria. An "expression vector" refers to a vector that contains the necessary control sequences or regulatory elements for expression of the antibodies including antibody fragment of the invention, in bacterial or eukaryotic cells. Suitable vectors are disclosed below. As used in this specification and the appended claims, the singular forms "a," "an" and "the" include plural references unless the content clearly dictates otherwise.

The invention also includes nucleic acid sequences encoding part or all of the light and heavy chains and CDRs of the present invention. Due to redundancy of the genetic code, variants of these sequences will exist that encode the same amino acid sequences.

Variant antibodies are also included within the scope of the invention. Thus, variants of the sequences recited in the application are also included within the scope of the invention. Further variants of the antibody sequences having improved affinity may be obtained using methods known in the art and are included within the scope of the invention. For example, amino acid substitutions may be used to obtain antibodies with further improved affinity. Alternatively, codon optimization of the nucleotide sequence may be used to improve the efficiency of translation in expression systems for the production of the antibody.

Preferably, such variant antibody sequences will share 70% or more (i.e. 80, 85, 90, 95, 97, 98, 99% or more) sequence identity with the sequences recited in the application. Preferably such sequence identity is calculated with regard to the full length of the reference sequence (i.e. the sequence recited in the application). Preferably, percentage identity, as referred to herein, is as determined using BLAST version 2.1.3 using the default parameters specified by the NCBI (the National Center for Biotechnology Information; http://www.ncbi.nlm.nih.gov/) [Blosum 62 matrix; gap open penalty=11 and gap extension penalty=1].

Further included within the scope of the invention are vectors such as expression vectors, comprising a nucleic acid sequence according to the invention. Cells transformed with such vectors are also included within the scope of the invention.

As will be understood by the skilled artisan, general description of antibodies herein and methods of preparing and using the same also apply to individual antibody polypeptide constituents and antibody fragments.

The antibodies of the present invention may be polyclonal or monoclonal antibodies. However, in preferred embodiments, they are monoclonal. In particular embodiments, antibodies of the present invention are human antibodies. Methods of producing polyclonal and monoclonal antibodies are known in the art and described generally, e.g., in U.S. Pat. No. 6,824,780.

Typically, the antibodies of the present invention are produced recombinantly, using vectors and methods available in the art, as described further below. Human antibodies may also be generated by in vitro activated B cells (see U.S. Pat. Nos. 5,567,610 and 5,229,275).

Human antibodies may also be produced in transgenic animals (e.g., mice) that are capable of producing a full repertoire of human antibodies in the absence of endogenous immunoglobulin production. For example, it has been described that the homozygous deletion of the antibody heavy-chain joining region (JH) gene in chimeric and germline mutant mice results in complete inhibition of endogenous antibody production. Transfer of the human germ-line immunoglobulin gene array into such germ-line mutant mice results in the production of human antibodies upon antigen challenge. See, e.g., Jakobovits et al., Proc. Natl. Acad. Sci. USA, 90:2551 (1993); Jakobovits et al., Nature, 362:255-258 (1993); Bruggemann et al., Year in Immuno., 7:33 (1993); U.S. Pat. Nos. 5,545,806, 5,569,825, 5,591,669 (all of GenPharm); U.S. Pat. No. 5,545,807; and WO 97/17852. Such animals may be genetically engineered to produce human antibodies comprising a polypeptide of the present invention.

In certain embodiments, antibodies of the present invention are chimeric antibodies that comprise sequences derived from both human and non-human sources. In particular embodiments, these chimeric antibodies are humanized or Primatized™. In practice, humanized antibodies are typically human antibodies in which some hypervariable region residues and possibly some FR residues are substituted by residues from analogous sites in rodent antibodies.

In the context of the present invention, chimeric antibodies also include human antibodies wherein the human hypervariable region or one or more CDRs are retained, but one or more other regions of sequence have been replaced by corresponding sequences from a non-human animal.

The choice of non-human sequences, both light and heavy, to be used in making the chimeric antibodies is important to reduce antigenicity and human anti-non-human antibody responses when the antibody is intended for human therapeutic use. It is further important that chimeric antibodies retain high binding affinity for the antigen and other favorable biological properties. To achieve this goal, according to a preferred method, chimeric antibodies are prepared by a process of analysis of the parental sequences and various conceptual chimeric products using three-dimensional models of the parental human and non-human sequences. Three-dimensional immunoglobulin models are commonly available and are familiar to those skilled in the art. Computer programs are available which illustrate and display probable three-dimensional conformational structures of selected candidate immunoglobulin sequences.

Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the hypervariable region residues are directly and most substantially involved in influencing antigen binding.

As noted above, antibodies (or immunoglobulins) can be divided into five different classes, based on differences in the amino acid sequences in the constant region of the heavy chains. All immunoglobulins within a given class have very similar heavy chain constant regions. These differences can be detected by sequence studies or more commonly by serological means (i.e. by the use of antibodies directed to these differences). Antibodies, or fragments thereof, of the present invention may be any class, and may, therefore, have a gamma, mu, alpha, delta, or epsilon heavy chain. A gamma chain may be gamma 1, gamma 2, gamma 3, or gamma 4; and an alpha chain may be alpha 1 or alpha 2.

In a preferred embodiment, an antibody of the present invention, or fragment thereof, is an IgG. IgG is considered the most versatile immunoglobulin, because it is capable of carrying out all of the functions of immunoglobulin molecules. IgG is the major Ig in serum, and the only class of Ig that crosses the placenta. IgG also fixes complement, although the IgG4 subclass does not. Macrophages, monocytes, PMN's and some lymphocytes have Fc receptors for the Fc region of IgG. Not all subclasses bind equally well: $IgG_2$ and $IgG_4$ do not bind to Fc receptors. A consequence of binding to the Fc receptors on PMN's, monocytes and macrophages is that the cell can now internalize the antigen better. IgG is an opsonin that enhances phagocytosis. Binding of IgG to Fc receptors on other types of cells results in the activation of other functions. Antibodies of the present invention may be of any IgG subclass.

In another preferred embodiment, an antibody, or fragment thereof, of the present invention is an IgE. IgE is the least common serum Ig since it binds very tightly to Fc receptors on basophils and mast cells even before interacting with antigen. As a consequence of its binding to basophils and mast cells, IgE is involved in allergic reactions. Binding of the allergen to the IgE on the cells results in the release of various pharmacological mediators that result in allergic symptoms. IgE also plays a role in parasitic helminth diseases. Eosinophils have Fc receptors for IgE and binding of eosinophils to IgE-coated helminths results in killing of the parasite. IgE does not fix complement.

In various embodiments, antibodies of the present invention, and fragments thereof, comprise a variable light chain that is either kappa or lambda. The lamba chain may be any of subtype, including, e.g., lambda 1, lambda 2, lambda 3, and lambda 4.

As noted above, the present invention further provides antibody fragments comprising a polypeptide of the present invention. In certain circumstances there are advantages of using antibody fragments, rather than whole antibodies. For example, the smaller size of the fragments allows for rapid clearance, and may lead to improved access to certain tissues, such as solid tumors. Examples of antibody fragments include: Fab, Fab', F(ab')2 and Fv fragments; diabodies; linear antibodies; single-chain antibodies; and multispecific antibodies formed from antibody fragments.

Various techniques have been developed for the production of antibody fragments. Traditionally, these fragments were derived via proteolytic digestion of intact antibodies (see, e.g., Morimoto et al., Journal of Biochemical and Biophysical Methods 24:107-117 (1992); and Brennan et al., Science, 229:81 (1985)). However, these fragments can now be produced directly by recombinant host cells. Fab, Fv and ScFv antibody fragments can all be expressed in and secreted from E. coli, thus allowing the facile production of large amounts of these fragments. Fab'-SH fragments can be directly recovered from *E. coli* and chemically coupled to form F(ab')2 fragments (Carter et al., Bio/Technology 10:163-167 (1992)). According to another approach, F(ab')2 fragments can be isolated directly from recombinant host cell culture. Fab and F(ab')2 fragment with increased in vivo half-life comprising a salvage receptor binding epitope residues are described in U.S. Pat. No. 5,869,046. Other techniques for the production of antibody fragments will be apparent to the skilled practitioner.

In other embodiments, the antibody of choice is a single chain Fv fragment (scFv). See WO 93/16185; U.S. Pat. Nos. 5,571,894; and 5,587,458. Fv and sFv are the only species with intact combining sites that are devoid of constant regions. Thus, they are suitable for reduced nonspecific binding during in vivo use. sFv fusion proteins may be constructed to yield fusion of an effector protein at either the amino or the carboxy terminus of an sFv. See Antibody Engineering, ed. Borrebaeck, supra. The antibody fragment may also be a "linear antibody", e.g., as described in U.S. Pat. No. 5,641,870 for example. Such linear antibody fragments may be monospecific or bispecific.

In certain embodiments, antibodies of the present invention are bispecific or multi-specific. Bispecific antibodies are antibodies that have binding specificities for at least two different epitopes. Exemplary bispecific antibodies may bind to two different epitopes of a single antigen. Other such antibodies may combine a first antigen binding site with a binding site for a second antigen. Alternatively, an anti-HIV1 arm may be combined with an arm that binds to a triggering molecule on a leukocyte, such as a T-cell receptor molecule (e.g., CD3), or Fc receptors for IgG (FcγR), such as FcγRI (CD64), FcγRII (CD32) and FcγRIII (CD16), so as to focus and localize cellular defense mechanisms to the infected cell. Bispecific antibodies may also be used to localize cytotoxic agents to infected cells. These antibodies possess an HIV1-binding arm and an arm that binds the cytotoxic agent (e.g., saporin, anti-interferon-α, *vinca* alkaloid, ricin A chain, methotrexate or radioactive isotope hapten). Bispecific antibodies can be prepared as full length antibodies or antibody fragments (e.g., F(ab')2 bispecific antibodies). WO 96/16673 describes a bispecific anti-ErbB2/anti-FcγRIII antibody and U.S. Pat. No. 5,837,234 discloses a bispecific anti-ErbB2/anti-FcγRI antibody. A bispecific anti-ErbB2/Fca antibody is shown in WO98/02463. U.S. Pat. No. 5,821,337 teaches a bispecific anti-ErbB2/anti-CD3 antibody.

Methods for making bispecific antibodies are known in the art. Traditional production of full length bispecific antibodies is based on the co-expression of two immunoglobulin heavy chain-light chain pairs, where the two chains have different specificities (Millstein et al., Nature, 305:537-539 (1983)). Because of the random assortment of immunoglobulin heavy and light chains, these hybridomas (quadromas) produce a potential mixture of ten different antibody molecules, of which only one has the correct bispecific structure. Purification of the correct molecule, which is usually done by affinity chromatography steps, is rather cumbersome, and the product yields are low. Similar procedures are disclosed in WO 93/08829, and in Traunecker et al., EMBO J., 10:3655-3659 (1991).

According to a different approach, antibody variable regions with the desired binding specificities (antibody-antigen combining sites) are fused to immunoglobulin constant domain sequences. Preferably, the fusion is with an Ig heavy chain constant domain, comprising at least part of the hinge, $C_H2$, and $C_H3$ regions. It is preferred to have the first heavy-chain constant region ($C_H1$) containing the site necessary for light chain bonding, present in at least one of the fusions. DNAs encoding the immunoglobulin heavy chain fusions and, if desired, the immunoglobulin light chain, are inserted into separate expression vectors, and are co-transfected into a suitable host cell. This provides for greater flexibility in adjusting the mutual proportions of the three polypeptide fragments in embodiments when unequal ratios of the three polypeptide chains used in the construction provide the optimum yield of the desired bispecific antibody. It is, however, possible to insert the coding sequences for two or all three polypeptide chains into a single expression vector when the expression of at least two polypeptide chains in equal ratios results in high yields or when the ratios have no significant affect on the yield of the desired chain combination.

In a preferred embodiment of this approach, the bispecific antibodies are composed of a hybrid immunoglobulin heavy chain with a first binding specificity in one arm, and a hybrid immunoglobulin heavy chain-light chain pair (providing a second binding specificity) in the other arm. It was found that this asymmetric structure facilitates the separation of the desired bispecific compound from unwanted immunoglobulin chain combinations, as the presence of an immunoglobulin light chain in only one half of the bispecific molecule provides for a facile way of separation. This approach is disclosed in WO 94/04690. For further details of generating bispecific antibodies see, for example, Suresh et al., Methods in Enzymology, 121:210 (1986).

According to another approach described in U.S. Pat. No. 5,731,168, the interface between a pair of antibody molecules can be engineered to maximize the percentage of heterodimers that are recovered from recombinant cell culture. The preferred interface comprises at least a part of the $C_H3$ domain. In this method, one or more small amino acid side chains from the interface of the first antibody molecule are replaced with larger side chains (e.g., tyrosine or tryptophan). Compensatory "cavities" of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers.

Bispecific antibodies include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art, and are disclosed in U.S. Pat. No. 4,676,980, along with a number of cross-linking techniques.

Techniques for generating bispecific antibodies from antibody fragments have also been described in the literature. For example, bispecific antibodies can be prepared using chemical linkage. Brennan et al., Science, 229: 81 (1985) describe a procedure wherein intact antibodies are proteolytically cleaved to generate F(ab')2 fragments. These fragments are reduced in the presence of the dithiol complexing agent, sodium arsenite, to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Recent progress has facilitated the direct recovery of Fab'-SH fragments from E. coli, which can be chemically coupled to form bispecific antibodies. Shalaby et al., J. Exp. Med., 175: 217-225 (1992) describe the production of a humanized bispecific antibody F(ab')2 molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., J. Immunol., 148(5):1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA, 90:6444-6448 (1993) has provided an alternative mechanism for making bispecific antibody fragments. The fragments comprise a $V_H$ connected to a $V_L$ by a linker that is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See Gruber et al., J. Immunol., 152:5368 (1994).

Antibodies with more than two valencies are contemplated. For example, trispecific antibodies can be prepared. Tutt et al., J. Immunol. 147: 60 (1991). A multivalent antibody may be internalized (and/or catabolized) faster than a bivalent antibody by a cell expressing an antigen to which the antibodies bind. The antibodies of the present invention can be multivalent antibodies with three or more antigen binding sites (e.g., tetravalent antibodies), which can be readily produced by recombinant expression of nucleic acid encoding the polypeptide chains of the antibody. The multivalent antibody can comprise a dimerization domain and three or more antigen binding sites. The preferred dimerization domain comprises (or consists of) an Fc region or a hinge region. In this scenario, the antibody will comprise an Fc region and three or more antigen binding sites amino-terminal to the Fc region. The preferred multivalent antibody herein comprises (or consists of) three to about eight, but preferably four, antigen binding sites. The multivalent antibody comprises at least one polypeptide chain (and preferably two polypeptide chains), wherein the polypeptide chain (s) comprise two or more variable regions. For instance, the polypeptide chain(s) may comprise VD1-(X1)$_n$-VD2-(X2)$_n$-Fc, wherein VD1 is a first variable region, VD2 is a second variable region, Fc is one polypeptide chain of an Fc region, X1 and X2 represent an amino acid or polypeptide, and n is 0 or 1. For instance, the polypeptide chain(s) may comprise: VH-CH1-flexible linker-VH-CH1-Fc region chain; or VH-CH1-VH-CH1-Fc region chain. The multivalent antibody herein preferably further comprises at least two (and preferably four) light chain variable region polypeptides. The multivalent antibody herein may, for instance, comprise from about two to about eight light chain variable region polypeptides. The light chain variable region polypeptides contemplated here comprise a light chain variable region and, optionally, further comprise a $C_L$ domain.

Antibodies of the invention further include single chain antibodies. In particular embodiments, antibodies of the invention are internalizing antibodies.

Amino acid sequence modification(s) of the antibodies described herein are contemplated. For example, it may be desirable to improve the binding affinity and/or other biological properties of the antibody. Amino acid sequence variants of the antibody may be prepared by introducing appropriate nucleotide changes into a polynucleotide that encodes the antibody, or a chain thereof, or by peptide synthesis. Such modifications include, for example, deletions from, and/or insertions into and/or substitutions of, residues within the amino acid sequences of the antibody. Any combination of deletion, insertion, and substitution may be made to arrive at the final antibody, provided that the final construct possesses the desired characteristics. The amino acid changes also may alter post-translational processes of the antibody, such as changing the number or position of glycosylation sites. Any of the variations and modifications described above for polypeptides of the present invention may be included in antibodies of the present invention.

A useful method for identification of certain residues or regions of an antibody that are preferred locations for mutagenesis is called "alanine scanning mutagenesis" as described by Cunningham and Wells in Science, 244:1081-1085 (1989). Here, a residue or group of target residues are identified (e.g., charged residues such as arg, asp, his, lys, and glu) and replaced by a neutral or negatively charged amino acid (most preferably alanine or polyalanine) to affect the interaction of the amino acids with PSCA antigen. Those amino acid locations demonstrating functional sensitivity to the substitutions then are refined by introducing further or other variants at, or for, the sites of substitution. Thus, while the site for introducing an amino acid sequence variation is predetermined, the nature of the mutation per se need not be predetermined. For example, to analyze the performance of a mutation at a given site, ala scanning or random mutagenesis is conducted at the target codon or region and the expressed anti-antibody variants are screened for the desired activity.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue or the antibody fused to a cytotoxic polypeptide. Other insertional variants of an antibody include the fusion to the N- or C-terminus of the antibody to an enzyme (e.g., for ADEPT) or a polypeptide that increases the serum half-life of the antibody.

Another type of variant is an amino acid substitution variant. These variants have at least one amino acid residue in the antibody molecule replaced by a different residue. The sites of greatest interest for substitutional mutagenesis include the hypervariable regions, but FR alterations are also contemplated. Conservative and non-conservative substitutions are contemplated.

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain.

Any cysteine residue not involved in maintaining the proper conformation of the antibody also may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

One type of substitutional variant involves substituting one or more hypervariable region residues of a parent antibody. Generally, the resulting variant(s) selected for further development will have improved biological properties relative to the parent antibody from which they are generated. A convenient way for generating such substitutional variants involves affinity maturation using phage display. Briefly, several hypervariable region sites (e.g., 6-7 sites) are mutated to generate all possible amino substitutions at each site. The antibody variants thus generated are displayed in a monovalent fashion from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the antibody and an antigen or infected cell. Such contact residues and neighboring residues are candidates for substitution according to the techniques elaborated herein. Once such variants are generated, the panel of variants is subjected to screening as described herein and antibodies with superior properties in one or more relevant assays may be selected for further development.

Another type of amino acid variant of the antibody alters the original glycosylation pattern of the antibody. By altering is meant deleting one or more carbohydrate moieties found in the antibody, and/or adding one or more glycosylation sites that are not present in the antibody. Glycosylation of antibodies is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used. Addition of glycosylation sites to the antibody is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original antibody (for O-linked glycosylation sites).

The antibody of the invention is modified with respect to effector function, e.g., so as to enhance antigen-dependent cell-mediated cyotoxicity (ADCC) and/or complement dependent cytotoxicity (CDC) of the antibody. This may be achieved by introducing one or more amino acid substitutions in an Fc region of the antibody. Alternatively or additionally, cysteine residue(s) may be introduced in the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., J. Exp Med. 176:1191-1195 (1992) and Shopes, B. J. Immunol. 148:2918-2922 (1992). Homodimeric antibodies with enhanced anti-infection activity may also be prepared using heterobifunctional cross-linkers as described in Wolff et al., Cancer Research 53:2560-2565 (1993). Alternatively, an antibody can be engineered which has dual Fc regions and may thereby have enhanced complement lysis and ADCC capabilities. See Stevenson et al., Anti-Cancer Drug Design 3:219-230 (1989). To increase the serum half-life of the antibody, one may incorporate a salvage receptor binding epitope into the antibody (especially an antibody fragment) as described in U.S. Pat. No. 5,739,277, for example. As used herein, the term "salvage receptor binding epitope" refers to an epitope of the Fc region of an IgG molecule (e.g., $IgG_1$, $IgG_2$, $IgG_3$, or $IgG_4$) that is responsible for increasing the in vivo serum half-life of the IgG molecule.

Antibodies of the present invention may also be modified to include an epitope tag or label, e.g., for use in purification or diagnostic applications. The invention also pertains to therapy with immunoconjugates comprising an antibody conjugated to an anti-cancer agent such as a cytotoxic agent or a growth inhibitory agent. Chemotherapeutic agents useful in the generation of such immunoconjugates have been described above.

Conjugates of an antibody and one or more small molecule toxins, such as a calicheamicin, maytansinoids, a trichothene, and CC1065, and the derivatives of these toxins that have toxin activity, are also contemplated herein.

In one preferred embodiment, an antibody (full length or fragments) of the invention is conjugated to one or more maytansinoid molecules. Maytansinoids are mitototic inhibitors that act by inhibiting tubulin polymerization. Maytansine was first isolated from the east African shrub *Maytenus serrata* (U.S. Pat. No. 3,896,111). Subsequently, it was discovered that certain microbes also produce maytansinoids, such as maytansinol and C-3 maytansinol esters (U.S. Pat. No. 4,151,042). Synthetic maytansinol and derivatives and analogues thereof are disclosed, for example, in U.S. Pat. Nos. 4,137,230; 4,248,870; 4,256,746; 4,260,608; 4,265,814; 4,294,757; 4,307,016; 4,308,268; 4,308,269; 4,309,428; 4,313,946; 4,315,929; 4,317,821; 4,322,348; 4,331,598; 4,361,650; 4,364,866; 4,424,219; 4,450,254; 4,362,663; and 4,371,533.

In an attempt to improve their therapeutic index, maytansine and maytansinoids have been conjugated to antibodies specifically binding to tumor cell antigens. Immunoconjugates containing maytansinoids and their therapeutic use are disclosed, for example, in U.S. Pat. Nos. 5,208,020, 5,416,064 and European Patent EP 0 425 235 B1. Liu et al., Proc. Natl. Acad. Sci. USA 93:8618-8623 (1996) described immunoconjugates comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay.

Antibody-maytansinoid conjugates are prepared by chemically linking an antibody to a maytansinoid molecule without significantly diminishing the biological activity of either the antibody or the maytansinoid molecule. An average of 3-4 maytansinoid molecules conjugated per antibody molecule has shown efficacy in enhancing cytotoxicity of target cells without negatively affecting the function or solubility of the antibody, although even one molecule of toxin/antibody would be expected to enhance cytotoxicity over the use of naked antibody. Maytansinoids are well known in the art and can be synthesized by known techniques or isolated from natural sources. Suitable maytansinoids are disclosed, for example, in U.S. Pat. No. 5,208,020 and in the other patents and nonpatent publications referred to hereinabove. Preferred maytansinoids are maytansinol and maytansinol analogues modified in the aromatic ring or at other positions of the maytansinol molecule, such as various maytansinol esters.

There are many linking groups known in the art for making antibody conjugates, including, for example, those disclosed in U.S. Pat. No. 5,208,020 or EP Patent 0 425 235 Bl, and Chari et al., Cancer Research 52: 127-131 (1992). The linking groups include disufide groups, thioether groups, acid labile groups, photolabile groups, peptidase labile groups, or esterase labile groups, as disclosed in the above-identified patents, disulfide and thioether groups being preferred.

Immunoconjugates may be made using a variety of bifunctional protein coupling agents such as N-succinimidyl-3-(2-pyridyldithio)propionate (SPDP), succinimidyl-4-(N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl)hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). Particularly preferred coupling agents include N-succinimidyl-3-(2-pyridyldithio) propionate (SPDP) (Carlsson et al., Biochem. J. 173:723-737 [1978]) and N-succinimidyl-4-(2-pyridylthio) pentanoate (SPP) to provide for a disulfide linkage. For example, a ricin immunotoxin can be prepared as described in Vitetta et al., Science 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026. The linker may be a "cleavable linker" facilitating release of the cytotoxic drug in the cell. For example, an acid-labile linker, Cancer Research 52: 127-131 (1992); U.S. Pat. No. 5,208,020) may be used.

Another immunoconjugate of interest comprises an antibody conjugated to one or more calicheamicin molecules. The calicheamicin family of antibiotics is capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296 (all to American Cyanamid Company). Another drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

Examples of other agents that can be conjugated to the antibodies of the invention include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof that can be used include, e.g., diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. See, for example, WO 93/21232.

The present invention further includes an immunoconjugate formed between an antibody and a compound with nucleolytic activity (e.g., a ribonuclease or a DNA endonuclease such as a deoxyribonuclease; DNase).

For selective destruction of infected cells, the antibody includes a highly radioactive atom. A variety of radioactive isotopes are available for the production of radioconjugated anti-PSCA antibodies. Examples include $At^{211}$, $I^{131}$, $I_{125}$, $Y^{90}$, $Re^{186}$, $Sm^{153}$, $Bi^{212}$, $P^{32}$, $Pb^{212}$ and radioactive isotopes of Lu. When the conjugate is used for diagnosis, it may comprise a radioactive atom for scintigraphic studies, for example $tc^{99m}$ or $I^{123}$, or a spin label for nuclear magnetic resonance (NMR) imaging (also known as magnetic resonance imaging, mri), such as iodine-123, iodine-131, indium-111, fluorine-19, carbon-13, nitrogen-15, oxygen-17, gadolinium, manganese or iron.

The radio- or other label is incorporated in the conjugate in known ways. For example, the peptide may be biosynthesized or may be synthesized by chemical amino acid synthesis using suitable amino acid precursors involving, for example, fluorine-19 in place of hydrogen. Labels such as $tc^{99m}$ or $I^{123}$, $Re^{186}$, $Re^{188}$ and $In^{111}$ can be attached via a cysteine residue in the peptide. Yttrium-90 can be attached via a lysine residue. The IODOGEN method (Fraker et al. (1978) Biochem. Biophys. Res. Commun. 80: 49-57 can be used to incorporate iodine-123. "Monoclonal Antibodies in Immunoscintigraphy" (Chatal, CRC Press 1989) describes other methods in detail.

Alternatively, a fusion protein comprising the antibody and cytotoxic agent is made, e.g., by recombinant techniques or peptide synthesis. The length of DNA may comprise respective regions encoding the two portions of the conjugate either adjacent one another or separated by a region encoding a linker peptide which does not destroy the desired properties of the conjugate. The antibodies of the present invention are also used in antibody dependent enzyme mediated prodrug therapy (ADET) by conjugating the antibody to a prodrug-activating enzyme which converts a prodrug (e.g., a peptidyl chemotherapeutic agent, see WO81/01145) to an active anti-cancer drug (see, e.g., WO 88/07378 and U.S. Pat. No. 4,975,278).

The enzyme component of +the immunoconjugate useful for ADEPT includes any enzyme capable of acting on a prodrug in such a way so as to convert it into its more active, cytotoxic form. Enzymes that are useful in the method of this invention include, but are not limited to, alkaline phosphatase useful for converting phosphate-containing prodrugs into free drugs; arylsulfatase useful for converting sulfate-containing prodrugs into free drugs; cytosine deaminase useful for converting non-toxic 5-fluorocytosine into the anti-cancer drug, 5-fluorouracil; proteases, such as *serratia* protease, thermolysin, subtilisin, carboxypeptidases and cathepsins (such as cathepsins B and L), that are useful for converting peptide-containing prodrugs into free drugs;

D-alanylcarboxypeptidases, useful for converting prodrugs that contain D-amino acid substituents; carbohydrate-cleaving enzymes such as β-galactosidase and neuraminidase useful for converting glycosylated prodrugs into free drugs; β-lactamase useful for converting drugs derivatized with β-lactams into free drugs; and penicillin amidases, such as penicillin V amidase or penicillin G amidase, useful for converting drugs derivatized at their amine nitrogens with phenoxyacetyl or phenylacetyl groups, respectively, into free drugs. Alternatively, antibodies with enzymatic activity, also known in the art as "abzymes", can be used to convert the prodrugs of the invention into free active drugs (see, e.g., Massey, Nature 328: 457-458 (1987)). Antibody-abzyme conjugates can be prepared as described herein for delivery of the abzyme to a infected cell population.

The enzymes of this invention can be covalently bound to the antibodies by techniques well known in the art such as the use of the heterobifunctional crosslinking reagents discussed above. Alternatively, fusion proteins comprising at least the antigen binding region of an antibody of the invention linked to at least a functionally active portion of an enzyme of the invention can be constructed using recombinant DNA techniques well known in the art (see, e.g., Neuberger et al., Nature, 312: 604-608 (1984).

Other modifications of the antibody are contemplated herein. For example, the antibody may be linked to one of a variety of nonproteinaceous polymers, e.g., polyethylene glycol, polypropylene glycol, polyoxyalkylenes, or copolymers of polyethylene glycol and polypropylene glycol. The antibody also may be entrapped in microcapsules prepared, for example, by coacervation techniques or by interfacial polymerization (for example, hydroxymethylcellulose or gelatin-microcapsules and poly-(methylmethacylate) microcapsules, respectively), in colloidal drug delivery systems (for example, liposomes, albumin microspheres, microemulsions, nano-particles and nanocapsules), or in macroemulsions. Such techniques are disclosed in Remington's Pharmaceutical Sciences, 16th edition, Oslo, A., Ed., (1980).

The antibodies disclosed herein are also formulated as immunoliposomes. A "liposome" is a small vesicle composed of various types of lipids, phospholipids and/or surfactant that is useful for delivery of a drug to a mammal. The components of the liposome are commonly arranged in a bilayer formation, similar to the lipid arrangement of biological membranes. Liposomes containing the antibody are prepared by methods known in the art, such as described in Epstein et al., Proc. Natl. Acad. Sci. USA, 82:3688 (1985); Hwang et al., Proc. Natl Acad. Sci. USA, 77:4030 (1980); U.S. Pat. Nos. 4,485,045 and 4,544,545; and WO97/38731 published Oct. 23, 1997. Liposomes with enhanced circulation time are disclosed in U.S. Pat. No. 5,013,556.

Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired a diameter. Fab' fragments of the antibody of the present invention can be conjugated to the liposomes as described in Martin et al., J. Biol. Chem. 257: 286-288 (1982) via a disulfide interchange reaction. A chemotherapeutic agent is optionally contained within the liposome. See Gabizon et al., J. National Cancer Inst. 81(19)1484 (1989). Antibodies of the present invention, or fragments thereof, may possess any of a variety of biological or functional characteristics. In certain embodiments, these antibodies are HIV1 protein specific antibodies, indicating that they specifically bind to or preferentially bind to HIV1 as compared to a normal control cell.

In particular embodiments, an antibody of the present invention is an antagonist antibody, which partially or fully blocks or inhibits a biological activity of a polypeptide or cell to which it specifically or preferentially binds. In other embodiments, an antibody of the present invention is a growth inhibitory antibody, which partially or fully blocks or inhibits the growth of an infected cell to which it binds. In another embodiment, an antibody of the present invention induces apoptosis. In yet another embodiment, an antibody of the present invention induces or promotes antibody-dependent cell-mediated cytotoxicity or complement dependent cytotoxicity.

HIV1-expressing cells or virus described above are used to screen the biological sample obtained from a patient infected with HIV1 for the presence of antibodies that preferentially bind to the cell expressing HIV1 polypeptides using standard biological techniques. For example, in certain embodiments, the antibodies may be labeled, and the presence of label associated with the cell detected, e.g., using FMAT or FACs analysis. In particular embodiments, the biological sample is blood, serum, plasma, bronchial lavage, or saliva. Methods of the present invention may be practiced using high throughput techniques.

Identified human antibodies may then be characterized further. For example the particular conformational epitopes with in the HIV1 polypeptides that are necessary or sufficient for binding of the antibody may be determined, e.g., using site-directed mutagenesis of expressed HIV1 polypeptides. These methods may be readily adapted to identify human antibodies that bind any protein expressed on a cell surface. Furthermore, these methods may be adapted to determine binding of the antibody to the virus itself, as opposed to a cell expressing recombinant HIV1 or infected with the virus.

Polynucleotide sequences encoding the antibodies, variable regions thereof, or antigen-binding fragments thereof may be subcloned into expression vectors for the recombinant production of human anti-HIV1 antibodies. In one embodiment, this is accomplished by obtaining mononuclear cells from the patient from the serum containing the identified HIV1 antibody was obtained; producing B cell clones from the mononuclear cells; inducing the B cells to become antibody-producing plasma cells; and screening the supernatants produced by the plasma cells to determine if it contains the HIV1 antibody. Once a B cell clone that produces an HIV1 antibody is identified, reverse-transcription polymerase chain reaction (RT-PCR) is performed to clone the DNAs encoding the variable regions or portions thereof of the HIV1 antibody. These sequences are then subcloned into expression vectors suitable for the recombinant production of human HIV1 antibodies. The binding specificity may be confirmed by determining the recombinant antibody's ability to bind cells expressing HIV1 polypeptide.

In particular embodiments of the methods described herein, B cells isolated from peripheral blood or lymph nodes are sorted, e.g., based on their being CD19 positive, and plated, e.g., as low as a single cell specificity per well, e.g., in 96, 384, or 1536 well configurations. The cells are induced to differentiate into antibody-producing cells, e.g., plasma cells, and the culture supernatants are harvested and tested for binding to cells expressing the infectious agent polypeptide on their surface using, e.g., FMAT or FACS analysis. Positive wells are then subjected to whole well RT-PCR to amplify heavy and light chain variable regions of the IgG molecule expressed by the clonal daughter plasma cells. The resulting PCR products encoding the heavy and light chain variable regions, or portions thereof, are subcloned into human antibody expression vectors for recombinant expression. The resulting recombinant antibodies are then tested to confirm their original binding specificity and may be further tested for pan-specificity across various strains of isolates of the infectious agent.

Thus, in one embodiment, a method of identifying HIV1 antibodies is practiced as follows. First, full length or approximately full length HIV1 cDNAs are transfected into a cell line for expression of HIV1 polypeptides. Secondly, individual human plasma or sera samples are tested for antibodies that bind the cell-expressed HIV1 polypeptides. And lastly, MAbs derived from plasma- or serum-positive individuals are characterized for binding to the same cell-expressed HIV1 polypeptides. Further definition of the fine specificities of the MAbs can be performed at this point.

Polynucleotides that encode the HIV1 antibodies or portions thereof of the present invention may be isolated from cells expressing HIV1 antibodies, according to methods available in the art and described herein, including amplification by polymerase chain reaction using primers specific for conserved regions of human antibody polypeptides. For example, light chain and heavy chain variable regions may be cloned from the B cell according to molecular biology techniques described in WO 92/02551; U.S. Pat. No. 5,627,052; or Babcook et al., *Proc. Natl. Acad. Sci. USA* 93:7843-48 (1996). In certain embodiments, polynucleotides encoding all or a region of both the heavy and light chain variable regions of the IgG molecule expressed by the clonal daughter plasma cells expressing the HIV1 antibody are subcloned and sequenced. The sequence of the encoded polypeptide may be readily determined from the polynucleotide sequence.

Isolated polynucleotides encoding a polypeptide of the present invention may be subcloned into an expression vector to recombinantly produce antibodies and polypeptides of the present invention, using procedures known in the art and described herein.

Binding properties of an antibody (or fragment thereof) to HIV1 polypeptides or HIv1 infected cells or tissues may generally be determined and assessed using immunodetection methods including, for example, immunofluorescence-based assays, such as immuno-histochemistry (IHC) and/or fluorescence-activated cell sorting (FACS). Immunoassay methods may include controls and procedures to determine whether antibodies bind specifically to HIVI polypeptides from one or more specific clades or strains of HIV, and do not recognize or cross-react with normal control cells.

Following pre-screening of serum to identify patients that produce antibodies to an infectious agent or polypeptide thereof, e.g., HIV1, the methods of the present invention typically include the isolation or purification of B cells from a biological sample previously obtained from a patient or subject. The patient or subject may be currently or previously diagnosed with or suspect or having a particular disease or infection, or the patient or subject may be considered free or a particular disease or infection. Typically, the patient or subject is a mammal and, in particular embodiments, a human. The biological sample may be any sample that contains B cells, including but not limited to, lymph node or lymph node tissue, pleural effusions, peripheral blood, ascites, tumor tissue, or cerebrospinal fluid (CSF). In various embodiments, B cells are isolated from different types of biological samples, such as a biological sample affected by a particular disease or infection. However, it is understood that any biological sample comprising B cells may be used for any of the embodiments of the present invention.

Once isolated, the B cells are induced to produce antibodies, e.g., by culturing the B cells under conditions that support B cell proliferation or development into a plasmacyte, plasmablast, or plasma cell. The antibodies are then screened, typically using high throughput techniques, to identify an antibody that specifically binds to a target antigen, e.g., a particular tissue, cell, infectious agent, or polypeptide. In certain embodiments, the specific antigen, e.g., cell surface polypeptide bound by the antibody is not known, while in other embodiments, the antigen specifically bound by the antibody is known.

According to the present invention, B cells may be isolated from a biological sample, e.g., a tumor, tissue, peripheral blood or lymph node sample, by any means known and available in the art. B cells are typically sorted by FACS based on the presence on their surface of a B cell-specific marker, e.g., CD19, CD138, and/or surface IgG. However, other methods known in the art may be employed, such as, e.g., column purification using CD19 magnetic beads or IgG-specific magnetic beads, followed by elution from the column. However, magnetic isolation of B cells utilizing any marker may result in loss of certain B cells. Therefore, in certain embodiments, the isolated cells are not sorted but, instead, phicol-purified mononuclear cells isolated from tumor are directly plated to the appropriate or desired number of specificities per well.

In order to identify B cells that produce an infectious agent-specific antibody, the B cells are typically plated at low density (e.g., a single cell specificity per well, 1-10 cells per well, 10-100 cells per well, 1-100 cells per well, less than 10 cells per well, or less than 100 cells per well) in multi-well or microtiter plates, e.g., in 96, 384, or 1536 well configurations. When the B cells are initially plated at a density greater than one cell per well, then the methods of the present invention may include the step of subsequently diluting cells in a well identified as producing an antigen-specific antibody, until a single cell specificity per well is achieved, thereby facilitating the identification of the B cell that produces the antigen-specific antibody. Cell supernatants or a portion thereof and/or cells may be frozen and stored for future testing and later recovery of antibody polynucleotides.

In certain embodiments, the B cells are cultured under conditions that favor the production of antibodies by the B cells. For example, the B cells may be cultured under conditions favorable for B cell proliferation and differentiation to yield antibody-producing plasmablast, plasmacytes, or plasma cells. In particular embodiments, the B cells are cultured in the presence of a B cell mitogen, such as lipopolysaccharide (LPS) or CD40 ligand. In one specific embodiment, B cells are differentiated to antibody-producing cells by culturing them with feed cells and/or other B cell activators, such as CD40 ligand.

Cell culture supernatants or antibodies obtained therefrom may be tested for their ability to bind to a target antigen, using routine methods available in the art, including those described herein. In particular embodiments, culture supernatants are tested for the presence of antibodies that bind to a target antigen using high-throughput methods. For example, B cells may be cultured in multi-well microtiter dishes, such that robotic plate handlers may be used to simultaneously sample multiple cell supernatants and test for the presence of antibodies that bind to a target antigen. In particular embodiments, antigens are bound to beads, e.g., paramagnetic or latex beads) to facilitate the capture of antibody/antigen complexes. In other embodiments, antigens and antibodies are fluorescently labeled (with different labels) and FACS analysis is performed to identify the presence of antibodies that bind to target antigen. In one embodiment, antibody binding is determined using FMAT™ analysis and instrumentation (Applied Biosystems, Foster City, Calif.). FMAT™ is a fluorescence macro-confocal platform for high-throughput screening, which mix-and-read, non-radioactive assays using live cells or beads.

In the context of comparing the binding of an antibody to a particular target antigen (e.g., a biological sample such as infected tissue or cells, or infectious agents) as compared to a control sample (e.g., a biological sample such as uninfected cells, or a different infectious agent), in various embodiments, the antibody is considered to preferentially bind a particular target antigen if at least two-fold, at least three-fold, at least five-fold, or at least ten-fold more antibody binds to the particular target antigen as compared to the amount that binds a control sample.

Polynucleotides encoding antibody chains, variable regions thereof, or fragments thereof, may be isolated from cells utilizing any means available in the art. In one embodiment, polynucleotides are isolated using polymerase chain reaction (PCR), e.g., reverse transcription-PCR (RT-PCR) using oligonucleotide primers that specifically bind to heavy or light chain encoding polynucleotide sequences or complements thereof using routine procedures available in the art. In one embodiment, positive wells are subjected to whole well RT-PCR to amplify the heavy and light chain variable regions of the IgG molecule expressed by the clonal daughter plasma cells. These PCR products may be sequenced.

The resulting PCR products encoding the heavy and light chain variable regions or portions thereof are then subcloned into human antibody expression vectors and recombinantly expressed according to routine procedures in the art (see, e.g., U.S. Pat. No. 7,112,439). The nucleic acid molecules encoding a tumor-specific antibody or fragment thereof, as described herein, may be propagated and expressed according to any of a variety of well-known procedures for nucleic acid excision, ligation, transformation, and transfection. Thus, in certain embodiments expression of an antibody fragment may be preferred in a prokaryotic host cell, such as *Escherichia coli* (see, e.g., Pluckthun et al., Methods Enzymol. 178:497-515 (1989)). In certain other embodiments, expression of the antibody or an antigen-binding fragment thereof may be preferred in a eukaryotic host cell, including yeast (e.g., *Saccharomyces cerevisiae, Schizosaccharomyces pombe*, and *Pichia pastoris*); animal cells (including mammalian cells); or plant cells. Examples of suitable animal cells include, but are not limited to, myeloma, COS, CHO, or hybridoma cells. Examples of plant cells include tobacco, corn, soybean, and rice cells. By methods known to those having ordinary skill in the art and based on the present disclosure, a nucleic acid vector may be designed for expressing foreign sequences in a particular host system, and then polynucleotide sequences encoding the tumor-specific antibody (or fragment thereof) may be inserted. The regulatory elements will vary according to the particular host.

One or more replicable expression vectors containing a polynucleotide encoding a variable and/or constant region may be prepared and used to transform an appropriate cell line, for example, a non-producing myeloma cell line, such as a mouse NSO line or a bacterium, such as *E. coli*, in which production of the antibody will occur. In order to obtain efficient transcription and translation, the polynucleotide sequence in each vector should include appropriate regulatory sequences, particularly a promoter and leader sequence operatively linked to the variable region sequence. Particular methods for producing antibodies in this way are generally well known and routinely used. For example, molecular biology procedures are described by Sambrook et al. (*Molecular Cloning, A Laboratory Manual*, 2nd ed., Cold Spring Harbor Laboratory, New York, 1989; see also Sambrook et al., 3rd ed., Cold Spring Harbor Laboratory, New York, (2001)). While not required, in certain embodiments, regions of polynucleotides encoding the recombinant antibodies may be sequenced. DNA sequencing can be performed as described in Sanger et al. (*Proc. Natl. Acad. Sci. USA* 74:5463 (1977)) and the Amersham International plc sequencing handbook and including improvements thereto.

In particular embodiments, the resulting recombinant antibodies or fragments thereof are then tested to confirm their original specificity and may be further tested for pan-specificity, e.g., with related infectious agents. In particular embodiments, an antibody identified or produced according to methods described herein is tested for cell killing via antibody dependent cellular cytotoxicity (ADCC) or apoptosis, and/or well as its ability to internalize.

The present invention, in other aspects, provides polynucleotide compositions. In preferred embodiments, these polynucleotides encode a polypeptide of the invention, e.g., a region of a variable chain of an antibody that binds to HIV1. Polynucleotides of the invention are single-stranded (coding or antisense) or double-stranded DNA (genomic, cDNA or synthetic) or RNA molecules. RNA molecules include, but are not limited to, HnRNA molecules, which contain introns and correspond to a DNA molecule in a one-to-one manner, and mRNA molecules, which do not contain introns. Alternatively, or in addition, coding or non-coding sequences are present within a polynucleotide of the present invention. Also alternatively, or in addition, a polynucleotide is linked to other molecules and/or support materials of the invention. Polynucleotides of the invention are used, e.g., in hybridization assays to detect the presence of an HIV1 antibody in a biological sample, and in the recombinant production of polypeptides of the invention. Further, the invention includes all polynucleotides that encode any polypeptide of the present invention.

In other related embodiments, the invention provides polynucleotide variants having substantial identity to the sequences of 1443_C16 (PG16) (TCN-116), 1503 H05 (PG16) (TCN-119), 1456 A12 (PG16) (TCN-117), 1469 M23 (PG16) (TCN-118), 1489_I13 (PG16) (TCN-120), 1480_I08 (PG16), 1456_P20 (PG20), 1460_G14 (PGG14), 1495_C14 (PGC14), 1496_C09 (PG9) (TCN-109), 4838_L06 (PGT-121), 4873_E03 (PGT-121), 4877_D15 (PGT-122), 4858_1'08 (PGT-123), 6123_A06 (PGT-125), 5141_B17 (PGT-126), 5145_B14 (PGT-127), 5114_A19 (PGT-128), 5147_N06 (PGT-130), 5136_H01 (PGT-131), 5343_B08 (PGT-135), 5344_E16 (PGT-135), 5329_C19 (PGT-136), 5366_P21 (PGT-136), 4964_G22 (PGT-141), 5345_101 (PGT-137), 4993_K13 (PGT-141), 4995_E20 (PGT-142), 4980_N08 (PGT-143), 4970_K22 (PGT-144), 4995_P16 (PGT-145), 4835_F12 (PGT-124), 4869-K15 (PGT-133), 4876_M06 (PGT-134), 5131_A17 (PGT-132), 5138_G07 (PGT-138), 5120_N10 (PGT-139), 6831_A21 (PGT-151), 6889_I17 (PGT-152), 6891_F06 (PGT-153), 6843_G20 (PGT-154), 6892_D19 (PGT-155), 6808_B09 (PGT-156), 6892_C23 (PGT-157), and/or 6881_N05 (PGT-158), for example those comprising at least 70% sequence identity, preferably at least 75%, 80%, 85%, 90%, 95%, 96%, 97%, 98%, or 99% or higher, sequence identity compared to a polynucleotide sequence of this invention, as determined using the methods described herein, (e.g., BLAST analysis using standard parameters). One skilled in this art will recognize that these values can be appropriately adjusted to determine corresponding identity of proteins encoded by two nucleotide sequences by taking into account codon degeneracy, amino acid similarity, reading frame positioning, and the like.

Typically, polynucleotide variants contain one or more substitutions, additions, deletions and/or insertions, preferably such that the immunogenic binding properties of the polypeptide encoded by the variant polynucleotide is not substantially diminished relative to a polypeptide encoded by a polynucleotide sequence specifically set forth herein.

In additional embodiments, the present invention provides polynucleotide fragments comprising various lengths of contiguous stretches of sequence identical to or complementary to one or more of the sequences disclosed herein. For example, polynucleotides are provided by this invention that comprise at least about 10, 15, 20, 30, 40, 50, 75, 100, 150, 200, 300, 400, 500 or 1000 or more contiguous nucleotides of one or more of the sequences disclosed herein as well as all intermediate lengths there between. As used herein, the term "intermediate lengths" is meant to describe any length between the quoted values, such as 16, 17, 18, 19, etc.; 21, 22, 23, etc.; 30, 31, 32, etc.; 50, 51, 52, 53, etc.; 100, 101, 102, 103, etc.; 150, 151, 152, 153, etc.; including all integers through 200-500; 500-1,000, and the like.

In another embodiment of the invention, polynucleotide compositions are provided that are capable of hybridizing under moderate to high stringency conditions to a polynucleotide sequence provided herein, or a fragment thereof, or a complementary sequence thereof. Hybridization techniques are well known in the art of molecular biology. For purposes of illustration, suitable moderately stringent conditions for testing the hybridization of a polynucleotide of this invention with other polynucleotides include prewashing in a solution of 5×SSC, 0.5% SDS, 1.0 mM EDTA (pH 8.0); hybridizing at 50° C.-60° C., 5×SSC, overnight; followed by washing twice at 65° C. for 20 minutes with each of 2×, 0.5× and 0.2×SSC containing 0.1% SDS. One skilled in the art will understand that the stringency of hybridization can be readily manipulated, such as by altering the salt content of the hybridization solution and/or the temperature at which the hybridization is performed. For example, in another embodiment, suitable highly stringent hybridization conditions include those described above, with the exception that the temperature of hybridization is increased, e.g., to 60-65° C. or 65-70° C.

In preferred embodiments, the polypeptide encoded by the polynucleotide variant or fragment has the same binding specificity (i.e., specifically or preferentially binds to the same epitope or HIV strain) as the polypeptide encoded by the native polynucleotide. In certain preferred embodiments, the polynucleotides described above, e.g., polynucleotide variants, fragments and hybridizing sequences, encode polypeptides that have a level of binding activity of at least about 50%, preferably at least about 70%, and more preferably at least about 90% of that for a polypeptide sequence specifically set forth herein.

The polynucleotides of the present invention, or fragments thereof, regardless of the length of the coding sequence itself, may be combined with other DNA sequences, such as promoters, polyadenylation signals, additional restriction enzyme sites, multiple cloning sites, other coding segments, and the like, such that their overall length may vary considerably. A nucleic acid fragment of almost any length is employed, with the total length preferably being limited by the ease of preparation and use in the intended recombinant DNA protocol. For example, illustrative polynucleotide segments with total lengths of about 10,000, about 5000, about 3000, about 2,000, about 1,000, about 500, about 200, about 100, about 50 base pairs in length, and the like, (including all intermediate lengths) are included in many implementations of this invention.

It will be appreciated by those of ordinary skill in the art that, as a result of the degeneracy of the genetic code, there are multiple nucleotide sequences that encode a polypeptide as described herein. Some of these polynucleotides bear minimal homology to the nucleotide sequence of any native gene. Nonetheless, polynucleotides that encode a polypeptide of the present invention but which vary due to differences in codon usage are specifically contemplated by the invention. Further, alleles of the genes including the polynucleotide sequences provided herein are within the scope of the invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

In certain embodiments of the present invention, mutagenesis of the disclosed polynucleotide sequences is performed in order to alter one or more properties of the encoded polypeptide, such as its binding specificity or binding strength. Techniques for mutagenesis are well-known in the art, and are widely used to create variants of both polypeptides and polynucleotides. A mutagenesis approach, such as site-specific mutagenesis, is employed for the preparation of variants and/or derivatives of the polypeptides described herein. By this approach, specific modifications in a polypeptide sequence are made through mutagenesis of the underlying polynucleotides that encode them. These techniques provides a straightforward approach to prepare and test sequence variants, for example, incorporating one or more of the foregoing considerations, by introducing one or more nucleotide sequence changes into the polynucleotide.

Site-specific mutagenesis allows the production of mutants through the use of specific oligonucleotide sequences include the nucleotide sequence of the desired mutation, as well as a sufficient number of adjacent nucleotides, to provide a primer sequence of sufficient size and sequence complexity to form a stable duplex on both sides of the deletion junction being traversed. Mutations are employed in a selected polynucleotide sequence to improve, alter, decrease, modify, or otherwise change the properties of the polynucleotide itself, and/or alter the properties, activity, composition, stability, or primary sequence of the encoded polypeptide.

In other embodiments of the present invention, the polynucleotide sequences provided herein are used as probes or primers for nucleic acid hybridization, e.g., as PCR primers. The ability of such nucleic acid probes to specifically hybridize to a sequence of interest enables them to detect the presence of complementary sequences in a given sample. However, other uses are also encompassed by the invention, such as the use of the sequence information for the preparation of mutant species primers, or primers for use in preparing other genetic constructions. As such, nucleic acid segments of the invention that include a sequence region of at least about a 15-nucleotide long contiguous sequence that has the same sequence as, or is complementary to, a 15 nucleotide long contiguous sequence disclosed herein is particularly useful. Longer contiguous identical or complementary sequences, e.g., those of about 20, 30, 40, 50, 100, 200, 500, 1000 (including all intermediate lengths) including full length sequences, and all lengths in between, are also used in certain embodiments.

Polynucleotide molecules having sequence regions consisting of contiguous nucleotide stretches of 10-14, 15-20, 30, 50, or even of 100-200 nucleotides or so (including intermediate lengths as well), identical or complementary to a polynucleotide sequence disclosed herein, are particularly contemplated as hybridization probes for use in, e.g., Southern and Northern blotting, and/or primers for use in, e.g., polymerase chain reaction (PCR). The total size of fragment, as well as the size of the complementary stretch (es), ultimately depends on the intended use or application of the particular nucleic acid segment. Smaller fragments are generally used in hybridization embodiments, wherein the length of the contiguous complementary region may be varied, such as between about 15 and about 100 nucleotides, but larger contiguous complementarity stretches may be used, according to the length complementary sequences one wishes to detect.

The use of a hybridization probe of about 15-25 nucleotides in length allows the formation of a duplex molecule that is both stable and selective. Molecules having contiguous complementary sequences over stretches greater than 12 bases in length are generally preferred, though, in order to increase stability and selectivity of the hybrid, and thereby improve the quality and degree of specific hybrid molecules obtained. Nucleic acid molecules having gene-complementary stretches of 15 to 25 contiguous nucleotides, or even longer where desired, are generally preferred.

Hybridization probes are selected from any portion of any of the sequences disclosed herein. All that is required is to review the sequences set forth herein, or to any continuous portion of the sequences, from about 15-25 nucleotides in length up to and including the full length sequence, that one wishes to utilize as a probe or primer. The choice of probe and primer sequences is governed by various factors. For example, one may wish to employ primers from towards the termini of the total sequence.

Polynucleotide of the present invention, or fragments or variants thereof, are readily prepared by, for example, directly synthesizing the fragment by chemical means, as is commonly practiced using an automated oligonucleotide synthesizer. Also, fragments are obtained by application of nucleic acid reproduction technology, such as the PCR™ technology of U.S. Pat. No. 4,683,202, by introducing selected sequences into recombinant vectors for recombinant production, and by other recombinant DNA techniques generally known to those of skill in the art of molecular biology.

The invention provides vectors and host cells comprising a nucleic acid of the present invention, as well as recombinant techniques for the production of a polypeptide of the present invention. Vectors of the invention include those capable of replication in any type of cell or organism, including, e.g., plasmids, phage, cosmids, and mini chromosomes. In various embodiments, vectors comprising a polynucleotide of the present invention are vectors suitable for propagation or replication of the polynucleotide, or vectors suitable for expressing a polypeptide of the present invention. Such vectors are known in the art and commercially available.

Polynucleotides of the present invention are synthesized, whole or in parts that are then combined, and inserted into a vector using routine molecular and cell biology techniques, including, e.g., subcloning the polynucleotide into a linearized vector using appropriate restriction sites and restriction enzymes. Polynucleotides of the present invention are amplified by polymerase chain reaction using oligonucleotide primers complementary to each strand of the polynucleotide. These primers also include restriction enzyme cleavage sites to facilitate subcloning into a vector. The replicable vector components generally include, but are not limited to, one or more of the following: a signal sequence, an origin of replication, and one or more marker or selectable genes.

In order to express a polypeptide of the present invention, the nucleotide sequences encoding the polypeptide, or functional equivalents, are inserted into an appropriate expression vector, i.e., a vector that contains the necessary elements for the transcription and translation of the inserted coding sequence. Methods well known to those skilled in the art are used to construct expression vectors containing sequences encoding a polypeptide of interest and appropriate transcriptional and translational control elements. These methods include in vitro recombinant DNA techniques, synthetic techniques, and in vivo genetic recombination. Such techniques are described, for example, in Sambrook, J., et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York. N.Y.

A variety of expression vector/host systems are utilized to contain and express polynucleotide sequences. These include, but are not limited to, microorganisms such as bacteria transformed with recombinant bacteriophage, plasmid, or cosmid DNA expression vectors; yeast transformed with yeast expression vectors; insect cell systems infected with virus expression vectors (e.g., baculovirus); plant cell systems transformed with virus expression vectors (e.g., cauliflower mosaic virus, CaMV; tobacco mosaic virus, TMV) or with bacterial expression vectors (e.g., Ti or pBR322 plasmids); or animal cell systems.

Within one embodiment, the variable regions of a gene expressing a monoclonal antibody of interest are amplified from a hybridoma cell using nucleotide primers. These primers are synthesized by one of ordinary skill in the art, or may be purchased from commercially available sources (see, e.g., Stratagene (La Jolla, Calif.), which sells primers for amplifying mouse and human variable regions. The primers are used to amplify heavy or light chain variable regions, which are then inserted into vectors such as ImmunoZAP™ H or ImmunoZAP™ L (Stratagene), respectively. These vectors are then introduced into E. coli, yeast, or mammalian-based systems for expression. Large amounts of a single-chain protein containing a fusion of the $V_H$ and $V_L$ domains are produced using these methods (see Bird et al., Science 242:423-426 (1988)).

The "control elements" or "regulatory sequences" present in an expression vector are those non-translated regions of the vector, e.g., enhancers, promoters, 5' and 3' untranslated regions, that interact with host cellular proteins to carry out transcription and translation. Such elements may vary in their strength and specificity. Depending on the vector system and host utilized, any number of suitable transcription and translation elements, including constitutive and inducible promoters, are used.

Examples of promoters suitable for use with prokaryotic hosts include the phoa promoter, β-lactamase and lactose promoter systems, alkaline phosphatase promoter, a tryptophan (trp) promoter system, and hybrid promoters such as the tac promoter. However, other known bacterial promoters are suitable. Promoters for use in bacterial systems also usually contain a Shine-Dalgarno sequence operably linked to the DNA encoding the polypeptide. Inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like are used.

A variety of promoter sequences are known for eukaryotes and any are used according to the present invention. Virtually all eukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. All of these sequences are suitably inserted into eukaryotic expression vectors.

In mammalian cell systems, promoters from mammalian genes or from mammalian viruses are generally preferred. Polypeptide expression from vectors in mammalian host cells are controlled, for example, by promoters obtained from the genomes of viruses such as polyoma virus, fowlpox virus, adenovirus (e.g., Adenovirus 2), bovine papilloma virus, avian sarcoma virus, cytomegalovirus (CMV), a retrovirus, hepatitis-B virus and most preferably Simian Virus 40 (SV40), from heterologous mammalian promoters, e.g., the actin promoter or an immunoglobulin promoter, and from heat-shock promoters, provided such promoters are compatible with the host cell systems. If it is necessary to generate a cell line that contains multiple copies of the sequence encoding a polypeptide, vectors based on SV40 or EBV may be advantageously used with an appropriate selectable marker. One example of a suitable expression vector is pcDNA-3.1 (Invitrogen, Carlsbad, Calif.), which includes a CMV promoter.

A number of viral-based expression systems are available for mammalian expression of polypeptides. For example, in cases where an adenovirus is used as an expression vector, sequences encoding a polypeptide of interest may be ligated into an adenovirus transcription/translation complex consisting of the late promoter and tripartite leader sequence. Insertion in a non-essential E1 or E3 region of the viral genome may be used to obtain a viable virus that is capable of expressing the polypeptide in infected host cells (Logan, J. and Shenk, T. (1984) Proc. Natl. Acad. Sci. 81:3655-3659). In addition, transcription enhancers, such as the Rous sarcoma virus (RSV) enhancer, may be used to increase expression in mammalian host cells.

In bacterial systems, any of a number of expression vectors are selected depending upon the use intended for the expressed polypeptide. For example, when large quantities are desired, vectors that direct high level expression of fusion proteins that are readily purified are used. Such vectors include, but are not limited to, the multifunctional *E. coli* cloning and expression vectors such as BLUESCRIPT (Stratagene), in which the sequence encoding the polypeptide of interest may be ligated into the vector in frame with sequences for the amino-terminal Met and the subsequent 7 residues of β-galactosidase, so that a hybrid protein is produced; pIN vectors (Van Heeke, G. and S. M. Schuster (1989) J. Biol. Chem. 264:5503-5509); and the like. pGEX Vectors (Promega, Madison, Wis.) are also used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin, or factor XA protease cleavage sites so that the cloned polypeptide of interest can be released from the GST moiety at will.

In the yeast, *Saccharomyces cerevisiae*, a number of vectors containing constitutive or inducible promoters such as alpha factor, alcohol oxidase, and PGH are used. Examples of other suitable promoter sequences for use with yeast hosts include the promoters for 3-phosphoglycerate kinase or other glycolytic enzymes, such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase. For reviews, see Ausubel et al. (supra) and Grant et al. (1987) Methods Enzymol. 153:516-544. Other yeast promoters that are inducible promoters having the additional advantage of transcription controlled by growth conditions include the promoter regions for alcohol dehydrogenase 2, isocytochrome C, acid phosphatase, degradative enzymes associated with nitrogen metabolism, metallothionein, glyceraldehyde-3-phosphate dehydrogenase, and enzymes responsible for maltose and galactose utilization. Suitable vectors and promoters for use in yeast expression are further described in EP 73,657. Yeast enhancers also are advantageously used with yeast promoters.

In cases where plant expression vectors are used, the expression of sequences encoding polypeptides are driven by any of a number of promoters. For example, viral promoters such as the 35S and 19S promoters of CaMV are used alone or in combination with the omega leader sequence from TMV (Takamatsu, N. (1987) *EMBO J.* 6:307-311. Alternatively, plant promoters such as the small subunit of RUBISCO or heat shock promoters are used (Coruzzi, G. et al. (1984) EMBO J. 3:1671-1680; Broglie, R. et al. (1984) Science 224:838-843; and Winter, J., et al. (1991) Results Probl. Cell Differ. 17: 85-105). These constructs can be introduced into plant cells by direct DNA transformation or pathogen-mediated transfection. Such techniques are described in a number of generally available reviews (see, e.g., Hobbs, S. or Murry, L. E. in McGraw Hill Yearbook of Science and Technology (1992) McGraw Hill, New York, N.Y.; pp. 191-196).

An insect system is also used to express a polypeptide of interest. For example, in one such system, *Autographa californica* nuclear polyhedrosis virus (AcNPV) is used as a vector to express foreign genes in *Spodoptera frugiperda* cells or in *Trichoplusia* larvae. The sequences encoding the polypeptide are cloned into a non-essential region of the virus, such as the polyhedrin gene, and placed under control of the polyhedrin promoter. Successful insertion of the polypeptide-encoding sequence renders the polyhedrin gene inactive and produce recombinant virus lacking coat protein. The recombinant viruses are then used to infect, for example, *S. frugiperda* cells or *Trichoplusia* larvae, in which the polypeptide of interest is expressed (Engelhard, E. K. et al. (1994) Proc. Natl. Acad. Sci. 91:3224-3227).

Specific initiation signals are also used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon are provided. Furthermore, the initiation codon is in the correct reading frame to ensure correct translation of the inserted polynucleotide. Exogenous translational elements and initiation codons are of various origins, both natural and synthetic.

Transcription of a DNA encoding a polypeptide of the invention is often increased by inserting an enhancer sequence into the vector. Many enhancer sequences are known, including, e.g., those identified in genes encoding globin, elastase, albumin, a-fetoprotein, and insulin. Typically, however, an enhancer from a eukaryotic cell virus is used. Examples include the SV40 enhancer on the late side of the replication origin (bp 100-270), the cytomegalovirus early promoter enhancer, the polyoma enhancer on the late side of the replication origin, and adenovirus enhancers. See also Yaniv, Nature 297:17-18 (1982) on enhancing elements for activation of eukaryotic promoters. The enhancer is spliced into the vector at a position 5' or 3' to the polypeptide-encoding sequence, but is preferably located at a site 5' from the promoter.

Expression vectors used in eukaryotic host cells (yeast, fungi, insect, plant, animal, human, or nucleated cells from other multicellular organisms) typically also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding anti-PSCA antibody. One useful transcription termination component is the bovine growth hormone polyadenylation region. See WO94/11026 and the expression vector disclosed therein.

Suitable host cells for cloning or expressing the DNA in the vectors herein are the prokaryote, yeast, plant or higher eukaryote cells described above. Examples of suitable prokaryotes for this purpose include eubacteria, such as Gram-negative or Gram-positive organisms, for example, Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as Bacilli such as *B. subtilis* and *B. licheniformis* (e.g., *B. licheniformis* 41P disclosed in DD 266,710 published 12 Apr. 1989), *Pseudomonas* such as *P. aeruginosa*, and *Streptomyces*. One preferred *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting.

*Saccharomyces cerevisiae*, or common baker's yeast, is the most commonly used among lower eukaryotic host microorganisms. However, a number of other genera, species, and strains are commonly available and used herein, such as *Schizosaccharomyces pombe; Kluyveromyces* hosts such as, e.g., *K lactis, K fragilis* (ATCC 12,424), *K. bulgaricus* (ATCC 16,045), *K wickeramii* (ATCC 24,178), *K. waltii* (ATCC 56,500), *K. drosophilarum* (ATCC 36,906), *K. thermotolerans*, and *K. marxianus; yarrowia* (EP 402,226); *Pichia pastoris*. (EP 183,070); *Candida; Trichoderma* reesia (EP 244,234); *Neurospora crassa; Schwanniomyces* such as *Schwanniomyces occidentalis*; and filamentous fungi such as, e.g., *Neurospora, Penicillium, Tolypocladium*, and *Aspergillus* hosts such as *A. nidulans* and *A. niger*.

In certain embodiments, a host cell strain is chosen for its ability to modulate the expression of the inserted sequences or to process the expressed protein in the desired fashion. Such modifications of the polypeptide include, but are not limited to, acetylation, carboxylation. glycosylation, phosphorylation, lipidation, and acylation. Post-translational processing that cleaves a "prepro" form of the protein is also used to facilitate correct insertion, folding and/or function. Different host cells such as CHO, COS, HeLa, MDCK, HEK293, and WI38, which have specific cellular machinery and characteristic mechanisms for such post-translational activities, are chosen to ensure the correct modification and processing of the foreign protein.

Methods and reagents specifically adapted for the expression of antibodies or fragments thereof are also known and available in the art, including those described, e.g., in U.S. Pat. Nos. 4,816,567 and 6,331,415. In various embodiments, antibody heavy and light chains, or fragments thereof, are expressed from the same or separate expression vectors. In one embodiment, both chains are expressed in the same cell, thereby facilitating the formation of a functional antibody or fragment thereof.

Full length antibody, antibody fragments, and antibody fusion proteins are produced in bacteria, in particular when glycosylation and Fc effector function are not needed, such as when the therapeutic antibody is conjugated to a cytotoxic agent (e.g., a toxin) and the immunoconjugate by itself shows effectiveness in infected cell destruction. For expression of antibody fragments and polypeptides in bacteria, see, e.g., U.S. Pat. Nos. 5,648,237, 5,789,199, and 5,840,523, which describes translation initiation region (TIR) and signal sequences for optimizing expression and secretion. After expression, the antibody is isolated from the *E. coli* cell paste in a soluble fraction and can be purified through, e.g., a protein A or G column depending on the isotype. Final purification can be carried out using a process similar to that used for purifying antibody expressed e.g., in CHO cells.

Suitable host cells for the expression of glycosylated polypeptides and antibodies are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopicius* (mosquito), *Drosophila melanogaster* (fruitfly), and *Bombyx mori* have been identified. A variety of viral strains for transfection are publicly available, e.g., the L-1 variant of *Autographa californica* NPV and the Bm-5 strain of *Bombyx mori* NPV, and such viruses are used as the virus herein according to the present invention, particularly for transfection of *Spodoptera frugiperda* cells. Plant cell cultures of cotton, corn, potato, soybean, petunia, tomato, and tobacco are also utilized as hosts.

Methods of propagation of antibody polypeptides and fragments thereof in vertebrate cells in culture (tissue culture) are encompassed by the invention. Examples of mammalian host cell lines used in the methods of the invention are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TR1 cells (Mather et al., Annals N.Y. Acad. Sci. 383:44-68 (1982)); MRC 5 cells; FS4 cells; and a human hepatoma line (Hep G2).

Host cells are transformed with the above-described expression or cloning vectors for polypeptide production and cultured in conventional nutrient media modified as appropriate for inducing promoters, selecting transformants, or amplifying the genes encoding the desired sequences.

For long-term, high-yield production of recombinant proteins, stable expression is generally preferred. For example, cell lines that stably express a polynucleotide of interest are transformed using expression vectors that contain viral origins of replication and/or endogenous expression elements and a selectable marker gene on the same or on a separate vector. Following the introduction of the vector, cells are allowed to grow for 1-2 days in an enriched media before they are switched to selective media. The purpose of the selectable marker is to confer resistance to selection, and its presence allows growth and recovery of cells that successfully express the introduced sequences. Resistant clones of stably transformed cells are proliferated using tissue culture techniques appropriate to the cell type.

A plurality of selection systems are used to recover transformed cell lines. These include, but are not limited to, the herpes simplex virus thymidine kinase (Wigler, M. et al. (1977) *Cell* 11:223-32) and adenine phosphoribosyltransferase (Lowy, I. et al. (1990) *Cell* 22:817-23) genes that are employed in tk$^-$ or aprt$^-$ cells, respectively. Also, antimetabolite, antibiotic or herbicide resistance is used as the basis for selection; for example, dhfr, which confers resistance to methotrexate (Wigler, M. et al. (1980) *Proc. Natl. Acad. Sci.* 77:3567-70); npt, which confers resistance to the aminoglycosides, neomycin and G-418 (Colbere-Garapin, F. et al. (1981) *J. Mol. Biol.* 150:1-14); and als or pat, which confer resistance to chlorsulfuron and phosphinotricin acetyltransferase, respectively (Murry, supra). Additional selectable genes have been described. For example, trpB allows cells to utilize indole in place of tryptophan, and hisD allows cells to utilize histinol in place of histidine (Hartman, S. C. and R. C. Mulligan (1988) *Proc. Natl. Acad. Sci.* 85:8047-51). The use of visible markers has gained popularity with such markers as anthocyanins, beta-glucuronidase and its substrate GUS, and luciferase and its substrate luciferin, being widely used not only to identify transformants, but also to quantify the amount of transient or stable protein expression attributable to a specific vector system (Rhodes, C. A. et al. (1995) *Methods Mol. Biol.* 55:121-131).

Although the presence/absence of marker gene expression suggests that the gene of interest is also present, its presence and expression is confirmed. For example, if the sequence encoding a polypeptide is inserted within a marker gene sequence, recombinant cells containing sequences are identified by the absence of marker gene function. Alternatively, a marker gene is placed in tandem with a polypeptide-encoding sequence under the control of a single promoter. Expression of the marker gene in response to induction or selection usually indicates expression of the tandem gene as well.

Alternatively, host cells that contain and express a desired polynucleotide sequence are identified by a variety of procedures known to those of skill in the art. These procedures include, but are not limited to, DNA-DNA or DNA-RNA hybridizations and protein bioassay or immunoassay techniques which include, for example, membrane, solution, or chip based technologies for the detection and/or quantification of nucleic acid or protein.

A variety of protocols for detecting and measuring the expression of polynucleotide-encoded products, using either polyclonal or monoclonal antibodies specific for the product are known in the art. Nonlimiting examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on a given polypeptide is preferred for some applications, but a competitive binding assay may also be employed. These and other assays are described, among other places, in Hampton, R. et al. (1990; Serological Methods, a Laboratory Manual, APS Press, St Paul. Minn.) and Maddox, D. E. et al. (1983; J. Exp. Med. 158:1211-1216).

Various labels and conjugation techniques are known by those skilled in the art and are used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof are cloned into a vector for the production of an mRNA probe. Such vectors are known in the art, are commercially available, and are used to synthesize RNA probes in vitro by addition of an appropriate RNA polymerase such as T7, T3, or SP6 and labeled nucleotides. These procedures are conducted using a variety of commercially available kits. Suitable reporter molecules or labels, which are used include, but are not limited to, radionucleotides, enzymes, fluorescent, chemiluminescent, or chromogenic agents as well as substrates, cofactors, inhibitors, magnetic particles, and the like.

The polypeptide produced by a recombinant cell is secreted or contained intracellularly depending on the sequence and/or the vector used. Expression vectors containing polynucleotides of the invention are designed to contain signal sequences that direct secretion of the encoded polypeptide through a prokaryotic or eukaryotic cell membrane.

In certain embodiments, a polypeptide of the invention is produced as a fusion polypeptide further including a polypeptide domain that facilitates purification of soluble proteins. Such purification-facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Amgen, Seattle, Wash.). The inclusion of cleavable linker sequences such as those specific for Factor XA or enterokinase (Invitrogen. San Diego, Calif.) between the purification domain and the encoded polypeptide are used to facilitate purification. An exemplary expression vector provides for expression of a fusion protein containing a polypeptide of interest and a nucleic acid encoding 6 histidine residues preceding a thioredoxin or an enterokinase cleavage site. The histidine residues facilitate purification on IMIAC (immobilized metal ion affinity chromatography) as described in Porath, J. et al. (1992, Prot. Exp. Purif. 3:263-281) while the enterokinase cleavage site provides a means for purifying the desired polypeptide from the fusion protein. A discussion of vectors used for producing fusion proteins is provided in Kroll, D. J. et al. (1993; DNA Cell Biol. 12:441-453).

In certain embodiments, a polypeptide of the present invention is fused with a heterologous polypeptide, which may be a signal sequence or other polypeptide having a specific cleavage site at the N-terminus of the mature protein or polypeptide. The heterologous signal sequence selected preferably is one that is recognized and processed (i.e., cleaved by a signal peptidase) by the host cell. For prokaryotic host cells, the signal sequence is selected, for example, from the group of the alkaline phosphatase, penicillinase, lpp, or heat-stable enterotoxin II leaders. For yeast secretion, the signal sequence is selected from, e.g., the yeast invertase leader, a factor leader (including *Saccharomyces* and *Kluyveromyces* factor leaders), or acid phosphatase leader, the *C. albicans* glucoamylase leader, or the signal described in WO 90/13646. In mammalian cell expression, mammalian signal sequences as well as viral secretory leaders, for example, the herpes simplex gD signal, are available.

When using recombinant techniques, the polypeptide or antibody is produced intracellularly, in the periplasmic space, or directly secreted into the medium. If the polypeptide or antibody is produced intracellularly, as a first step, the particulate debris, either host cells or lysed fragments, are removed, for example, by centrifugation or ultrafiltration. Carter et al., Bio/Technology 10:163-167 (1992) describe a procedure for isolating antibodies that are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris is removed by centrifugation. Where the polypeptide or antibody is secreted into the medium, supernatants from such expression systems are generally first concentrated using a commercially available protein concentration filter, for example, an Amicon or Millipore Pellicon ultrafiltration unit. Optionally, a protease inhibitor such as PMSF is included in any of the foregoing steps to inhibit proteolysis and antibiotics are included to prevent the growth of adventitious contaminants.

The polypeptide or antibody composition prepared from the cells are purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the polypeptide or antibody. Protein A is used to purify antibodies or fragments thereof that are based on human $\gamma_1$, $\gamma_2$, or $\gamma_4$ heavy chains (Lindmark et al., J. Immunol. Meth. 62:1-13 (1983)). Protein G is recommended for all mouse isotypes and for human $\gamma_3$ (Guss et al., EMBO J. 5:15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the polypeptide or antibody comprises a $C_H3$ domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the polypeptide or antibody to be recovered.

Following any preliminary purification step(s), the mixture comprising the polypeptide or antibody of interest and contaminants are subjected to low pH hydrophobic interaction chromatography using an elution buffer at a pH between about 2.5-4.5, preferably performed at low salt concentrations (e.g., from about 0-0.25M salt).

The invention further includes pharmaceutical formulations including a polypeptide, antibody, or modulator of the present invention, at a desired degree of purity, and a pharmaceutically acceptable carrier, excipient, or stabilizer (Remingion's Pharmaceutical Sciences 16th edition, Osol, A. Ed. (1980)). In certain embodiments, pharmaceutical formulations are prepared to enhance the stability of the polypeptide or antibody during storage, e.g., in the form of lyophilized formulations or aqueous solutions.

Acceptable carriers, excipients, or stabilizers are nontoxic to recipients at the dosages and concentrations employed, and include, e.g., buffers such as acetate, Tris, phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; tonicifiers such as trehalose and sodium chloride; sugars such as sucrose, mannitol, trehalose or sorbitol; surfactant such as polysorbate; salt-forming counter-ions such as sodium; metal complexes (e.g. Zn-protein complexes); and/or non-ionic surfactants such as TWEEN™, PLURONICS™ or polyethylene glycol (PEG). In certain embodiments, the therapeutic formulation preferably comprises the polypeptide or antibody at a concentration of between 5-200 mg/ml, preferably between 10-100 mg/ml.

The formulations herein also contain one or more additional therapeutic agents suitable for the treatment of the particular indication, e.g., infection being treated, or to prevent undesired side-effects. Preferably, the additional therapeutic agent has an activity complementary to the polypeptide or antibody of the resent invention, and the two do not adversely affect each other. For example, in addition to the polypeptide or antibody of the invention, an additional or second antibody, anti-viral agent, anti-infective agent and/or cardioprotectant is added to the formulation. Such molecules are suitably present in the pharmaceutical formulation in amounts that are effective for the purpose intended.

The active ingredients, e.g., polypeptides and antibodies of the invention and other therapeutic agents, are also entrapped in microcapsules prepared, for example, by coacervation techniques or by interfacial polymerization, for example, hydroxymethylcellulose or gelatin-microcapsules and polymethylmethacylate) microcapsules, respectively, in colloidal drug delivery systems (for example, liposomes, albumin microspheres, microemulsions, nano-particles and nanocapsules) or in macroemulsions. Such techniques are disclosed in Remingion's Pharmaceutical Sciences 16th edition, Osol, A. Ed. (1980).

Sustained-release preparations are prepared. Suitable examples of sustained-release preparations include, but are not limited to, semi-permeable matrices of solid hydrophobic polymers containing the antibody, which matrices are in the form of shaped articles, e.g., films, or microcapsules. Nonlimiting examples of sustained-release matrices include polyesters, hydrogels (for example, poly(2-hydroxyethylmethacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxyburyric acid.

Formulations to be used for in vivo administration are preferably sterile. This is readily accomplished by filtration through sterile filtration membranes.

Antibodies of the invention can be coupled to a drug for delivery to a treatment site or coupled to a detectable label to facilitate imaging of a site comprising cells of interest, such as cells infected with HIV. Methods for coupling antibodies to drugs and detectable labels are well known in the art, as are methods for imaging using detectable labels. Labeled antibodies may be employed in a wide variety of assays, employing a wide variety of labels. Detection of the formation of an antibody-antigen complex between an antibody of the invention and an epitope of interest (an HIV epitope) can be facilitated by attaching a detectable substance to the antibody. Suitable detection means include the use of labels such as radionucleotides, enzymes, coenzymes, fluorescers, chemiluminescers, chromogens, enzyme substrates or co-factors, enzyme inhibitors, prosthetic group complexes, free radicals, particles, dyes, and the like. Examples of suitable enzymes include horseradish peroxidase, alkaline phosphatase, ß-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material is luminol; examples of bioluminescent materials include luciferase, luciferin, and aequorin; and examples of suitable radioactive material include $^{125}$I, $^{131}$I, $^{35}$S, or $^{3}$H. Such labeled reagents may be used in a variety of well-known assays, such as radioimmunoassays, enzyme immunoassays, e.g., ELISA, fluorescent immunoassays, and the like.

The antibodies are tagged with such labels by known methods. For instance, coupling agents such as aldehydes, carbodiimides, dimaleimide, imidates, succinimides, bid-diazotized benzadine and the like are used to tag the antibodies with the above-described fluorescent, chemiluminescent, and enzyme labels. An enzyme is typically combined with an antibody using bridging molecules such as carbodiimides, periodate, diisocyanates, glutaraldehyde and the like. Various labeling techniques are described in Morrison, Methods in Enzymology 32b, 103 (1974), Syvanen et al., J. Biol. Chem. 284, 3762 (1973) and Bolton and Hunter, Biochem J. 133, 529(1973).

An antibody according to the invention may be conjugated to a therapeutic moiety such as a cytotoxin, a therapeutic agent, or a radioactive metal ion or radioisotope. Examples of radioisotopes include, but are not limited to, I-131, I-123, I-125, Y-90, Re-188, Re-186, At-211, Cu-67, Bi-212, Bi-213, Pd-109, Tc-99, In-111, and the like. Such antibody conjugates can be used for modifying a given biological response; the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin.

Techniques for conjugating such therapeutic moiety to antibodies are well known. See, for example, Arnon et al. (1985) "Monoclonal Antibodies for Immunotargeting of Drugs in Cancer Therapy," in Monoclonal Antibodies and Cancer Therapy, ed. Reisfeld et al. (Alan R. Liss, Inc.), pp. 243-256; ed. Hellstrom et al. (1987) "Antibodies for Drug Delivery," in Controlled Drug Delivery, ed. Robinson et al. (2d ed; Marcel Dekker, Inc.), pp. 623-653; Thorpe (1985) "Antibody Carriers of Cytotoxic Agents in Cancer Therapy: A Review," in Monoclonal Antibodies '84: Biological and Clinical Applications, ed. Pinchera et al. pp. 475-506 (Editrice Kurtis, Milano, Italy, 1985); "Analysis, Results, and Future Prospective of the Therapeutic Use of Radiolabeled Antibody in Cancer Therapy," in Monoclonal Antibodies for Cancer Detection and Therapy, ed. Baldwin et al. (Academic Press, New York, 1985), pp. 303-316; and Thorpe et al. (1982) Immunol. Rev. 62:119-158.

Diagnostic methods generally involve contacting a biological sample obtained from a patient, such as, e.g., blood, serum, saliva, urine, sputum, a cell swab sample, or a tissue biopsy, with an HIV1 antibody and determining whether the antibody preferentially binds to the sample as compared to a control sample or predetermined cut-off value, thereby indicating the presence of infected cells. In particular embodiments, at least two-fold, three-fold, or five-fold more HIV1 antibody binds to an infected cell as compared to an appropriate control normal cell or tissue sample. A predetermined cut-off value is determined, e.g., by averaging the amount of HIV1 antibody that binds to several different appropriate control samples under the same conditions used to perform the diagnostic assay of the biological sample being tested.

Bound antibody is detected using procedures described herein and known in the art. In certain embodiments, diagnostic methods of the invention are practiced using HIV1 antibodies that are conjugated to a detectable label, e.g., a fluorophore, to facilitate detection of bound antibody. However, they are also practiced using methods of secondary detection of the HIV1 antibody. These include, for example, RIA, ELISA, precipitation, agglutination, complement fixation and immuno-fluorescence.

HIV1 antibodies of the present invention are capable of differentiating between patients with and patients without an HIV infection, and determining whether or not a patient has an infection, using the representative assays provided herein. According to one method, a biological sample is obtained from a patient suspected of having or known to have HIV1 infection. In preferred embodiments, the biological sample includes cells from the patient. The sample is contacted with an HIV1 antibody, e.g., for a time and under conditions sufficient to allow the HIV1 antibody to bind to infected cells present in the sample. For instance, the sample is contacted with an HIV1 antibody for 10 seconds, 30 seconds, 1 minute, 5 minutes, 10 minutes, 30 minutes, 1 hour, 6 hours, 12 hours, 24 hours, 3 days or any point in between. The amount of bound HIV1 antibody is determined and compared to a control value, which may be, e.g., a predetermined value or a value determined from normal tissue sample. An increased amount of antibody bound to the patient sample as compared to the control sample is indicative of the presence of infected cells in the patient sample.

In a related method, a biological sample obtained from a patient is contacted with an HIV1 antibody for a time and under conditions sufficient to allow the antibody to bind to infected cells. Bound antibody is then detected, and the presence of bound antibody indicates that the sample contains infected cells. This embodiment is particularly useful when the HIV1 antibody does not bind normal cells at a detectable level.

Different HIV1 antibodies possess different binding and specificity characteristics. Depending upon these characteristics, particular HIV1 antibodies are used to detect the presence of one or more strains of HIV1. For example, certain antibodies bind specifically to only one or several strains of HIV1, whereas others bind to all or a majority of different strains of HIV1. Antibodies specific for only one strain of HIV1 are used to identify the strain of an infection.

In certain embodiments, antibodies that bind to an infected cell preferably generate a signal indicating the presence of an infection in at least about 20% of patients with the infection being detected, more preferably at least about 30% of patients. Alternatively, or in addition, the antibody generates a negative signal indicating the absence of the infection in at least about 90% of individuals without the infection being detected. Each antibody satisfies the above criteria; however, antibodies of the present invention are used in combination to improve sensitivity.

The present invention also includes kits useful in performing diagnostic and prognostic assays using the antibodies of the present invention. Kits of the invention include a suitable container comprising an HIV1 antibody of the invention in either labeled or unlabeled form. In addition, when the antibody is supplied in a labeled form suitable for an indirect binding assay, the kit further includes reagents for performing the appropriate indirect assay. For example, the kit includes one or more suitable containers including enzyme substrates or derivatizing agents, depending on the nature of the label. Control samples and/or instructions are also included.

Passive immunization has proven to be an effective and safe strategy for the prevention and treatment of viral diseases. (See Keller et al., Clin. Microbiol. Rev. 13:602-14 (2000); Casadevall, Nat. Biotechnol. 20:114 (2002); Shibata et al., Nat. Med. 5:204-10 (1999); and Igarashi et al., Nat. Med. 5:211-16 (1999), each of which are incorporated herein by reference)). Passive immunization using human monoclonal antibodies, provide an immediate treatment strategy for emergency prophylaxis and treatment of HIV1.

HIV1 antibodies and fragments thereof, and therapeutic compositions, of the invention specifically bind or preferentially bind to infected cells, as compared to normal control uninfected cells and tissue. Thus, these HIV1 antibodies are used to selectively target infected cells or tissues in a patient, biological sample, or cell population. In light of the infection-specific binding properties of these antibodies, the present invention provides methods of regulating (e.g., inhibiting) the growth of infected cells, methods of killing infected cells, and methods of inducing apoptosis of infected cells. These methods include contacting an infected cell with an HIV1 antibody of the invention. These methods are practiced in vitro, ex vivo, and in vivo.

In various embodiments, antibodies of the invention are intrinsically therapeutically active. Alternatively, or in addition, antibodies of the invention are conjugated to a cytotoxic agent or growth inhibitory agent, e.g., a radioisotope or toxin that is used in treating infected cells bound or contacted by the antibody.

Subjects at risk for HIV1-related diseases or disorders include patients who have come into contact with an infected person or who have been exposed to HIV1 in some other way. Administration of a prophylactic agent can occur prior to the manifestation of symptoms characteristic of HIV1-related disease or disorder, such that a disease or disorder is prevented or, alternatively, delayed in its progression.

Methods for preventing an increase in HIV1 virus titer, virus replication, virus proliferation or an amount of an HIV1 viral protein in a subject are further provided. In one embodiment, a method includes administering to the subject an amount of an HIV1 antibody effective to prevent an increase in HIV1 titer, virus replication or an amount of an HIV1 protein of one or more HIV strains or isolates in the subject.

For in vivo treatment of human and non-human patients, the patient is usually administered or provided a pharmaceutical formulation including an HIV1 antibody of the invention. When used for in vivo therapy, the antibodies of the invention are administered to the patient in therapeutically effective amounts (i.e., amounts that eliminate or reduce the patient's viral burden). The antibodies are administered to a human patient, in accord with known methods, such as intravenous administration, e.g., as a bolus or by continuous infusion over a period of time, by intramuscular, intraperitoneal, intracerobrospinal, subcutaneous, intra-articular, intrasynovial, intrathecal, oral, topical, or inhalation routes. The antibodies may be administered parenterally, when possible, at the target cell site, or intravenously. Intravenous or subcutaneous administration of the antibody is preferred in certain embodiments. Therapeutic compositions of the invention are administered to a patient or subject systemically, parenterally, or locally.

For parenteral administration, the antibodies are formulated in a unit dosage injectable form (solution, suspension, emulsion) in association with a pharmaceutically acceptable, parenteral vehicle. Examples of such vehicles are water, saline, Ringer's solution, dextrose solution, and 5% human serum albumin. Nonaqueous vehicles such as fixed oils and ethyl oleate are also used. Liposomes are used as carriers. The vehicle contains minor amounts of additives such as substances that enhance isotonicity and chemical stability, e.g., buffers and preservatives. The antibodies are typically formulated in such vehicles at concentrations of about 1 mg/ml to 10 mg/ml.

The dose and dosage regimen depends upon a variety of factors readily determined by a physician, such as the nature of the infection and the characteristics of the particular cytotoxic agent or growth inhibitory agent conjugated to the antibody (when used), e.g., its therapeutic index, the patient, and the patient's history. Generally, a therapeutically effective amount of an antibody is administered to a patient. In particular embodiments, the amount of antibody administered is in the range of about 0.1 mg/kg to about 50 mg/kg of patient body weight. Depending on the type and severity of the infection, about 0.1 mg/kg to about 50 mg/kg body weight (e.g., about 0.1-15 mg/kg/dose) of antibody is an initial candidate dosage for administration to the patient, whether, for example, by one or more separate administrations, or by continuous infusion. The progress of this therapy is readily monitored by conventional methods and assays and based on criteria known to the physician or other persons of skill in the art.

In one particular embodiment, an immunoconjugate including the antibody conjugated with a cytotoxic agent is administered to the patient. Preferably, the immunoconjugate is internalized by the cell, resulting in increased therapeutic efficacy of the immunoconjugate in killing the cell to which it binds. In one embodiment, the cytotoxic agent targets or interferes with the nucleic acid in the infected cell. Examples of such cytotoxic agents are described above and include, but are not limited to, maytansinoids, calicheamicins, ribonucleases and DNA endonucleases.

Other therapeutic regimens are combined with the administration of the HIV I antibody of the present invention. The combined administration includes co-administration, using separate formulations or a single pharmaceutical formulation, and consecutive administration in either order, wherein preferably there is a time period while both (or all) active agents simultaneously exert their biological activities. Preferably such combined therapy results in a synergistic therapeutic effect.

In certain embodiments, it is desirable to combine administration of an antibody of the invention with another antibody directed against another antigen associated with the infectious agent.

Aside from administration of the antibody protein to the patient, the invention provides methods of administration of the antibody by gene therapy. Such administration of nucleic acid encoding the antibody is encompassed by the expression "administering a therapeutically effective amount of an antibody". See, for example, PCT Patent Application Publication WO96/07321 concerning the use of gene therapy to generate intracellular antibodies.

In another embodiment, anti-HIV I antibodies of the invention are used to determine the structure of bound antigen, e.g., conformational epitopes, the structure of which is then used to develop a vaccine having or mimicking this structure, e.g., through chemical modeling and SAR methods. Such a vaccine could then be used to prevent HIV1 infection.

Although the present invention and its advantages have been described in detail, it should be understood that various changes, substitutions and alterations can be made herein without departing from the spirit and scope of the invention as defined in the appended claims.

The present invention will be further illustrated in the following Examples which are given for illustration purposes only and are not intended to limit the invention in any way.

EXAMPLES

Example 1: Selection of Patient Sample

Serum from approximately 1,800 HIV-1 infected donors from Asia, Australia, Europe, North America and sub-Saharan African countries were screened for neutralization activity and donors who exhibit among the broadest and most potent neutralizing serum activity observed to date were identified. (Simek, M. D., *J Virol* (2009)). Monoclonal antibodies were generated from these donors using different approaches.

A patient was selected based upon the patient's eligibility for enrollment, which was defined as: male or female at least 18 years of age with documented HIV infection for at least three years, clinically asymptomatic at the time of enrollment, and not currently receiving antiretroviral therapy. (Simek, M. D., *J Virol* (2009 July) 83(14):7337-48). Selection of individuals for monoclonal antibody generation was based on a rank-order high throughput analytical screening algorithm. The volunteer was identified as an individual with broad neutralizing serum based on broad and potent neutralizing activity against a cross-clade pseudovirus panel.

A novel high-throughput strategy was used to screen IgG-containing culture supernatants from approximately 30,000 activated memory B cells from a clade A infected donor for recombinant, monomeric $gp120_{JR-CSF}$ and $gp41_{HxB}2$ (Env) binding as well as neutralization activity against HIV-$1_{JR-CSF}$ and HIV-$1_{SF162}$ as shown in Table 1. The memory B cells were cultured at near clonal density such that the authentic antibody heavy and light chain pair could be reconstituted from each culture well.

Example 2: Generation of Monoclonal Antibodies

The human monoclonal antibody discovery platform utilized a short term B cell culture system to interrogate the memory B cell repertoire. 30,300 CD19$^+$ and surface IgG-expressing memory B cells were isolated from ten million peripheral blood mononuclear cells (PBMC) of the HIV-1 infected donor. CD19$^+$/sIgG$^+$ B cells were then seeded in 384-well microtiter plates at an average of 1.3 cells/well under conditions that promoted B cell activation, proliferation, terminal differentiation and antibody secretion. Culture supernatants were screened in a high throughput format for binding reactivity to recombinant gp120 and gp41 indirectly and directly immobilized on ELISA plates, respectively. In parallel, the culture supernatants were also screened for neutralization activity in a high throughput micro-neutralization assay.

Heavy and light variable regions were isolated from lysates of selected neutralizing hits by RT-PCR amplification using family-specific primer sets. From positive family-specific PCR reactions, pools of the VH or VL-region clones were cloned into an expression vector upstream to human IgG$_1$ constant domain sequence. Minipreps (QIAGEN, Valencia, Calif.) of these DNA pools, derived from suspension bacterial cultures, were combined in all possible heavy and light chain family-specific pairs and used to transiently transfect 293 cells. All transfectant supernatants containing secreted recombinant antibodies were screened in ELISA and neutralization assays. For B-cell wells that contained more than one B cell clone per culture well, multiple VH and VL domain sequences were isolated. ELISA (for B-cell wells positive for ELISA) and neutralization screens identified the heavy and light chain combination pools that reconstituted the binding and neutralizing activity as observed for the B-cell well. DNA sequences of the heavy and light chain variable regions for all neutralizing mAbs were confirmed by multiple sequencing reactions using purified DNA from maxipreps (QIAGEN).

Example 3: Screening of Monoclonal Antibodies for Binding to Recombinant gp120 and gp41 by ELISA Assay Recombinant gp120 with sequence derived from gp120 of primary HIV-1 isolate JR-CSF and expressed in insect cells was obtained from IAVI NAC repository. Recombinant gp41 generated with sequences derived from HxB2 clone of HIV-1 and expressed in *Pichia pastoris* was manufactured by Vybion, Inc., obtained from IAVI NAC repository Sheep anti-gp120 antibodies used as capturing agent to indirectly immobilize gp120 on ELISA plates was purchased from Aalto Bio Reagents (Dublin, Ireland). All ELISA assays were conducted at 25 μL/well on MaxiSorp plates from Nunc.

In anti-gp120 ELISA, recombinant gp120 (0.5 μg/ml) was captured on 384 well ELISA plates pre-coated (at 4° C. overnight) with goat anti-gp120 (5 μg/ml) in BSA-containing assay buffer (PBS with 0.05% Tween-20) for 1 hr at room temperature. After excess gp120 was removed and plates were washed thrice with assay buffer, B cell culture supernatants diluted 5-fold was added to incubate for 1 hr at room temperature. Following three washes in assay buffer, secondary HRP-conjugated goat anti-human Ig Fc in BSA-containing assay buffer was added and incubated for about 1 hr at room temperature. 3,3',5,5'-tetramethylbenzidine (TMB) substrate was used to develop the colorimetric readouts after washing the ELISA plates 3 times.

For anti-gp41 ELISA, recombinant gp41 was directly immobilized on 384 well ELISA plates by adding 1 µg/ml and incubating at 4° C. overnight, followed by blocking with BSA-containing assay buffer. The rest of the assay protocol was similar to that for anti-gp120 ELISA.

Hits from the ELISA assay were identified in a singlet screen based on optical density (OD) values above 3×assay background. A serial titration standard curve of control antibody was included on each plate.

Example 4: Neutralization Assay for Screening Antibodies Against Pseudotyped HIV Viruses The neutralization assay approach has been described previously (Binley J M, et al., (2004). Comprehensive Cross-Clade Neutralization Analysis of a Panel of Anti-Human Immunodeficiency Virus Type 1 Monoclonal Antibodies. J. Virol. 78: 13232-13252) and was modified and standardized for implementation in 384-well format.

Neutralization by monoclonal antibodies and patient sera was performed using a single round of replication pseudovirus assay. (Richman, D. D., et al. Proc Natl Acad Sci USA 100, 4144-4149 (2003)). Pseudovirus neutralization assays were performed using HIV-1$_{JR-CSF}$ alanine mutants as described in Pantophlet, R., et al. J Virol 77, 642-658 (2003). Neutralization activity was measured as a reduction in viral infectivity compared to an antibody-free control using a TZM-BL assay. (Li, M., et al., J Virol 79, 10108-10125 (2005)). Monoclonal antibody neutralization assays using phytohaemgglutinin-activated peripheral blood mononuclear cells (PBMC) isolated from three healthy human donors as target cells were performed as described in Scarlatti, G. et al, (1993) J. Infect. Dis. 168:207-210; Polonis, V. et al, (2001) AIDS Res. Hum. Retroviruses 17:69-79. Memory B cell supernatants were screened in a microneutralization assay against HIV-1sF162, HIV-1$_{JR-CSF}$, and SIV$_{mac239}$ (negative control). This assay was based on the 96-well pseudotyped HIV-1 neutralization assay (Monogram Biosciences) and was modified for screening 15 µl B cell culture supernatants in a 384-well format.

Pseudotyped virus from SF162 and JR-CSF isolates of HIV-1 and SIV mac239 (control virus) were generated by co-transfecting Human Embryonic Kidney 293 cells (293 cells) with 2 plasmids encoding the Envelope cDNA sequence and the rest of the HIV genome separately. In the HIV genome encoding vector, the Env gene was replaced by the firefly luciferase gene. Transfectant supernatants containing pseudotyped virus were co-incubated overnight (18 hours) with B cell supernatants derived from activation of an infected donor's primary peripheral blood mononuclear cells (PBMCs). U87 cells stably transfected with and expressing CD4 plus the CCR5 and CXCR4 coreceptors were added to the mixture and incubated for 3 days at 37° C. Infected cells were quantified by luminometry. SIV-mac239 was used as the negative control virus.

The neutralization index was expressed as the ratio of normalized relative luminescence units (RLU) of the test viral strain to that of the control virus SIVmac239 derived from the same test B cell culture supernatant. The cut-off values used to distinguish neutralizing hits were determined by the neutralization index of a large number of "negative control wells" containing B cell culture supernatants derived from healthy donors. The false positive rate using the cut-off value of 1.5 was very low (1-3%; FIG. 5A), and it was reduced to zero if the cut-off value of 2.0 was used (FIG. 5B).

FIG. 5 summarizes the screening results from which B cell cultures were selected for antibody rescue and the monoclonal antibodies 1496_S09 (PG9), 1443_C16 (PG16), 1456_P20 (PG20), 1460_G14 (PGG14), and 1495_C14 (PGC14) were derived. The results reveal that the majority of neutralizing B cell culture supernatants did not have binding reactivity to soluble recombinant gp120 or gp41 proteins.

Table 15 shows the screening results of the monoclonal antibodies 1496S09 (PG9), 1443_C16 (PG16), 1456_P20 (PG20), 1460_G14 (PGG14), and 1495_C14 (PGC14) during the course of their identification in the method described in this invention. The neutralization activity of each antibody and its corresponding binding reactivity to soluble recombinant gp120 or gp41, in the context of B cell culture supernatant and recombinant transfectant supernatants are illustrated.

TABLE 15

| B Cell Culture Hit Priority Rank | Sample ID by B Cell Culture | | Primary B Cell Culture Screening | | | |
|---|---|---|---|---|---|---|
| | | | Neutralization Index | | ELISA OD | |
| | Plate | Well | JRSCF | SF162 | gp120 | gp41 |
| 1 | 1456 | P20 | 42.77 | 1.63 | 3.78 | Neg |
| 1 | 1456 | P20 | 42.77 | 1.63 | 3.78 | Neg |
| 1 | 1456 | P20 | 42.77 | 1.63 | 3.78 | Neg |
| 1 | 1456 | P20 | 42.77 | 1.63 | 3.78 | Neg |
| 2 | 1477 | B12 | 18.52 | 0.81 | Neg | 2.02 |
| 2 | 1477 | B12 | 18.52 | 0.81 | Neg | 2.02 |
| 4 | 1443 | C16 | 179.12 | 1.11 | Neg | Neg |
| 4 | 1443 | C16 | 179.12 | 1.11 | Neg | Neg |
| 4 | 1443 | C16 | 179.12 | 1.11 | Neg | Neg |
| 5 | 1496 | C9 | 166.09 | 1.34 | Neg | Neg |
| 5 | 1496 | C9 | 166.09 | 1.34 | Neg | Neg |
| 5 | 1496 | C9 | 166.09 | 1.34 | Neg | Neg |
| 5 | 1496 | C9 | 166.09 | 1.34 | Neg | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |

TABLE 15-continued

| | | | | | | |
|---|---|---|---|---|---|---|
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 6 | 1495 | C14 | 1.42 | 87.13 | 3.76 | Neg |
| 10 | 1460 | G14 | 1.62 | 1.57 | 3.49 | Neg |
| 10 | 1460 | G14 | 1.62 | 1.57 | 3.49 | Neg |

Transfectant Screening for Recombinant Antibodies

| H & L Combinations | | Transfectant Quantitative ELISA | | Neutralization Index | |
|---|---|---|---|---|---|
| Heavy Chain Family | Light Chain Family | Average anti-gp-120 or anti-gp41 Conc* (µg/ml) | Average total IgG Conc (µg/ml) | JRCSF | SF162 |
| 1456 P20 γ1 | 1456 P20 k1 | 4.03 | 4.62 | 0.80 | 9.57 |
| 1456 P20 γ1 | 1456 P20 k1 | 4.03 | 4.62 | 0.80 | 9.57 |
| 1456 P20 γ1 | 1456 P20 k1 | 4.03 | 4.62 | 0.80 | 9.57 |
| 1456 P20 γ1 | 1456 P20 k1 | 4.03 | 4.62 | 0.80 | 9.57 |
| 1477 B12 γ3 | 1477 B12 λ2 | 0.04 | 3.23 | 13.25 | 1.20 |
| 1477 B12 γ3 | 1477 B12 λ2 | 0.04 | 3.23 | 13.25 | 1.20 |
| 1443 C16 γ1 | 1443 C16 λ2 | N/A | 0.63 | 2.96 | 0.86 |
| 1443 C16 γ1 | 1443 C16 λ2 | N/A | 1.63 | 2.96 | 0.86 |
| 1443 C16 γ3 | 1443 C16 λ2 | N/A | 3.50 | 115.86 | 0.88 |
| 1496 C09 γ3 | 1496 C09 λ2 | N/A | 5.61 | 111.45 | 0.58 |
| 1496 C09 γ3 | 1496 C09 λ3 | N/A | 5.73 | 115.76 | 0.63 |
| 1496 C09 γ3 | 1496 C09 λ5 | N/A | 4.22 | 86.86 | 0.67 |
| 1496 C09 γ3 | 1496 C09 λ7 | N/A | 0.92 | 261.00 | 1.14 |
| 1495 C14 γ1 | 1495 C14 λ1 | 160 | 2.66 | 1.67 | 56.48 |
| 1495 C14 γ1 | 1495 C14 λ3 | 2.20 | 3.34 | 1.67 | 84.87 |
| 1495 C14 γ1 | 1495 C14 λ3 | 2.20 | 3.34 | 0.80 | 84.87 |
| 1495 C14 γ1 | 1495 C14 λ3 | 2.20 | 3.34 | 0.80 | 84.87 |
| 1495 C14 γ1 | 1495 C14 λ3 | 2.20 | 3.34 | 0.80 | 84.87 |
| 1495 C14 γ1 | 1495 C14 λ3 | 2.20 | 3.34 | 0.80 | 84.87 |
| 1495 C14 γ1 | 1495 C14 λ3 | 2.20 | 3.34 | 0.80 | 84.87 |
| 1495 C14 γ1 | 1495 C14 λ3 | 2.20 | 3.34 | 0.80 | 84.87 |
| 1495 C14 γ1 | 1495 C14 λ3 | 2.20 | 3.34 | 0.80 | 84.87 |
| 1503 C14 γ1 | 1503 C14 λ5 | 0.39 | 0.64 | 0.58 | 18.95 |
| 1503 C14 γ1 | 1503 C14 λ5 | 0.39 | 0.64 | 0.58 | 18.95 |
| 1503 C14 γ1 | 1503 C14 λ5 | 0.39 | 0.64 | 0.58 | 18.95 |
| 1460 G14 k1 | 1460 G14 k1 | 13.41 | 16.25 | 0.61 | 17.07 |
| 1460 G14 k2 | 1460 G14 k2 | 12.49 | 14.61 | 0.81 | 15.37 |

Transfectant Screening for Recombinant Monoclonal Antibodies

| Clonal H & L Combinations | | Transfectant Quantitative ELISA | | Neutralization Index | |
|---|---|---|---|---|---|
| Heavy Chain Clone | Light Chain Clone | Average anti-gp-120 or anti-gp41 Conc* (µg/ml) | Average total IgG Conc (µg/ml) | JRCSF | SF162 |
| 1456 P20 γ1 018 | 1456 P20 k1 021 | 0.07 | 8.01 | 0.66 | 0.66 |
| 1456 P20 γ1 018 | 1456 P20 k1 024 | 0.01 | 6.81 | 0.88 | 0.78 |
| 1456 P20 γ1 023 | 1456 P20 k1 021 | 9.45 | 6.99 | 0.89 | 10.72 |
| 1456 P20 γ1 023 | 1456 P20 k1 024 | 12.49 | 7.76 | 1.39 | 20.83 |
| 1477 B12 γ3 017 | 1477 B12 λ2 022 | 0.00 | 5.98 | 0.72 | 0.83 |
| 1477 B12 γ3 023 | 1477 B12 λ2 022 | 10.96 | 6.02 | 0.90 | 0.94 |
| 1443 C16 γ1 018 | 1443 C16 λ2 019 | 0.00 | 0.25 | 1.00 | 1.07 |
| 1443 C16 γ1 021 | 1443 C16 λ2 019 | 0.00 | 1.51 | 0.97 | 1.20 |
| 1443 C16 γ3 023 | 1443 C16 λ2 019 | 0.00 | 6.38 | 55.62 | 0.67 |
| 1496 C09 γ3 017 | 1496 C09 λ2 017 | 0.00 | 8.60 | 282.47 | 1.10 |
| 1496 C09 γ3 017 | 1496 C09 λ3 024 | 0.00 | 12.31 | 227.65 | 0.94 |
| 1496 C09 γ3 017 | 1496 C09 λ5 023 | 0.00 | 0.00 | 1.21 | 0.86 |
| ND | ND | ND | ND | ND | ND |
| ND | ND | ND | ND | ND | ND |
| 1495 C14 γ1 017 | 1495 C14 λ3 017 | 0.00 | 0.00 | 0.89 | 0.97 |
| 1495 C14 γ1 017 | 1495 C14 λ3 018 | 0.20 | 1.43 | 0.91 | 7.97 |
| 1495 C14 γ1 017 | 1495 C14 λ3 022 | 0.22 | 1.65 | 0.89 | 9.90 |
| 1495 C14 γ1 020 | 1495 C14 λ3 017 | 0.00 | 0.00 | 0.86 | 0.81 |

TABLE 15-continued

| 1495 C14 γ1 020 | 1495 C14 λ3 018 | 12.61 | 3.76 | 1.26 | 95.15 |
| 1495 C14 γ1 020 | 1495 C14 λ3 022 | 13.03 | 3.95 | 0.91 | 105.92 |
| 1495 C14 γ1 022 | 1495 C14 λ3 017 | 0.00 | 0.00 | 1.07 | 0.79 |
| 1495 C14 γ1 022 | 1495 C14 λ3 018 | 4.65 | 2.30 | 1.13 | 60.60 |
| 1495 C14 γ1 022 | 1495 C14 λ3 022 | 5.91 | 3.18 | 0.89 | 39.65 |
| 1503 C14 γ1 017 | 1503 C14 λ5 020 | 0.00 | 0.00 | 0.84 | 0.69 |
| 1503 C14 γ1 020 | 1503 C14 λ5 020 | 0.00 | 0.00 | 0.95 | 0.65 |
| 1503 C14 γ1 022 | 1503 C14 λ5 020 | 0.00 | 0.00 | 0.99 | 0.87 |
| 1460 G14 γ1 023 | 1460 G14 k1 017 | 17.37 | 12.44 | 1.64 | 39.43 |
| ND | ND | ND | ND | ND | ND |

*Anti-gp120 and anti-gp41 concentrations were extrapolated from b12 and 2F5 standard curves in quantitative ELISA, respectively.
N/A = not applicable because these hits were neither gp-120 nor gp-41 positive in B cell culture.
ND = not done.

The purified monoclonal antibodies 1496_C09 (PG9), 1443_C16 (PG16), 1456_P20 (PG20), 1460_G14 (PGG14), and 1495_C14 (PGC14) were tested for neutralization of 6 additional HIV strains from clades A (94UG103), B (92BR020, JR-CSF), C (93IN905, IAVI_C22), and CRF01_AE (92TH021) (Table 16). The antibodies 1496_C09 (PG9), 1443_C16 (PG16) and 1495_C14 (PGC14) showed neutralization profile similar to that obtained with the donor sera neutralization profile. The pseudoviruses were preincubated with each monoclonal antibody for 1 hour or 18 hours prior to the infection of target cells. $IC_{50}$ values derived from 1 or 18 hours preincubation were similar. Therefore, in further neutralization assays testing purified monoclonal antibodies, 1 hour of preincubation was used.

Table 17A shows the neutralization profiles for the 5 monoclonal antibodies 1496_C09 (PG9), 1443_C16 (PG16), 1456_P20 (PG20), 1460_G14 (PGG14), and 1495_C14 (PGC14) in $IC_{50}$ values on an extended panel of 16 pseudoviruses, together with known cross-clade neutralizing antibodies b12, 2G12, 2F5 and 4E10.

Table 17B shows the IC90 of two monoclonal antibodies, 1443_C16 (PG16) and 1496_C09 (PG9) on the same expanded diverse panel of 16 HIV pseudoviruses from different clades, together with known cross-clade neutralizing antibodies b12, 2G12, 2F5 and 4E10. FIG. 4 shows neutralization activity of monoclonal antibodies 1443_C16 (PG16) and 1496_C09 (PG9) to 3 other pseudoviruses not included in Table 16.

TABLE 16

Neutralizing Antibody Assay: IC50 Summary

| Virus/Ab Incubation | | SF162 | 94UG103 | 92BR020 | 93IN905 | IAVI_C22 | 92TH021 | JRCSF | NL43 | aMLV |
| --- | --- | --- | --- | --- | --- | --- | --- | --- | --- | --- |
| 1 hour | 1443C16 | >50 | 0.0211 | >50 | 0.3302**** | 0.1143* | 0.1362* | <0.0025 | <0.0025 | >50 |
| 18 hour | 1443C16 | >50 | 0.0085 | >50 | 0.2553* | 0.1064* | 0.0435 | <0.0025 | 4.9874 | >50 |
| 1 hour | 1456P20 | 0.1946 | >50 | >50 | >50 | >50 | >50 | >50 | 0.20 | >50 |
| 18 hour | 1456P20 | 0.0661 | >50 | >50 | 3.8384* | >50 | >50 | >50 | 0.05 | >50 |
| 1 hour | 1460G14 | 0.1789 | >50 | >50 | >50 | >50 | >50 | >50 | 0.17 | >50 |
| 18 hour | 1460G14 | 0.0573 | >50 | >50 | 3.1738* | >50 | >50 | >50 | 0.05 | >50 |
| 1 hour | 1495C14 | 0.0069 | >50 | 1.1697 | >50 | >50 | >50 | >50 | 0.35 | >50 |
| 18 hour | 1495C14 | <0.0025 | >50 | 0.2442 | 0.1456* | 13.3798 | >50 | >50 | 0.15 | >50 |
| 1 hour | 1496C09 | >50 | 0.3336 | >50 | 0.1444 | 24.8611 | 0.0612 | <0.0025 | 0.2944* | >50 |
| 18 hour | 1496C09 | >50 | 0.0942 | >50 | 0.0619 | 2.1073 | 0.0571 | <0.0025 | 38.03 | >50 |
| 1 hour | Z23 (1/dil'n) | 13521 | 188 | 616 | 369 | 340 | 175 | 438 | 4793 | <100 |
| 18 hour | Z23 (1/dil'n) | 66074 | 262 | 1292 | 1396 | 614 | 336 | 1054 | 9472 | <100 |

*plateau
**flat inhibition curve - probably <0.0025 with plateau
***very long, shallow slope
****plateau with very long, shallow slope to curve

TABLE 17A

Neutralization Profile on a Diverse Panel of Viruses: $IC_{50}$ Values

| | | PG9 | PG16 | PGC14 | PGG14 | PG20 | b12 | 2G12 | 2F5 | 4E10 |
| --- | --- | --- | --- | --- | --- | --- | --- | --- | --- | --- |
| Clade A | 94UG103 | 0.1731 | 0.0080 | >50 | >50 | >50 | 3.54 | >50 | 3.79 | 9.7 |
| | 92RW020 | 0.0637 | 0.0040**** | 28.5960 | >50 | >50 | >50 | 0.56 | 3.37 | 3.38 |
| | 93UG077 | >50 | >50 | >50 | >50 | >50 | 41.12 | >50 | 4.45 | 11.15 |
| Clade B | 92BR020 | >50 | >50 | 0.6366 | >50 | >50 | 27.5 | 2.26 | >50 | 41.44 |
| | APV-13 | >50 | >50 | >50 | >50 | >50 | >25 | 23.9 | 2.8 | 3.8 |
| | APV-17 | 26.4465 | >50 | >50 | >50 | >50 | >25 | >50 | 2 | 5.1 |
| | APV-6 | 0.0869 | 0.08** | 7.4062 | >50 | 25.7798 | >25 | 5.3 | 0.1 | 0.4 |
| | JRCSF | <0.0025 | <0.0025 | >50 | >50 | >50 | 0.16 | 0.66 | 3.36 | 6 |

TABLE 17A-continued

Neutralization Profile on a Diverse Panel of Viruses: IC$_{50}$ Values

|  |  | PG9 | PG16 | PGC14 | PGG14 | PG20 | b12 | 2G12 | 2F5 | 4E10 |
|---|---|---|---|---|---|---|---|---|---|---|
| Clade C | 93IN905 | 0.1400 | 0.1016*** | >50 | >50 | >50 | 34.15 | >50 | >50 | 1.55 |
|  | IAVI-C18 | 0.0535 | 0.0067 | >50 | >50 | >50 | >50 | >50 | >50 | >50 |
|  | IAVI-C22 | 24.8600 | 0.0687* | 9.4999 | >50 | >50 | 3.6042 | >50 | >50 | 1.0229 |
|  | IAVI-C3 | 12.9103 | 14.8372 | >50 | >50 | >50 | 5.0000 | >50 | >50 | 5.0000 |
| Clade D | 92UG024 | 10.9552 | >50 | >50 | >50 | >50 | 49.06 | 0.59 | 1.27 | 1.32 |
|  | 92UG005 | >50 | >50 | >50 | >50 | >50 | >50 | >50 | 11.75 | 8.86 |
| CRF01_AE | 92TH021 | 0.1105 | 0.1273*** | >50 | >50 | >50 | 9.99 | >50 | 1.51 | 1.9 |
|  | CMU02 | >50 | >50 | >50 | >50 | >50 | 4.25 | >50 | 0.38 | 0.59 |
| Pos C | NL43 | N/A | <0.0025** | 0.3727 | 0.1717 | 0.1880 | 0.06 | 0.75 | 2.41 | 4.95 |
| Neg C | aMLV | >50 | >50 | >50 | >50 | >50 | >50 | >50 | >50 | >50 |

NA—Not Applicable
IC$_{50}$: Inhibitory concentration to inhibit 50% of the virus

TABLE 17B

Neutralization Profile on a Diverse Panel of Viruses: IC$_{90}$ Values for mAbs PG9 and PG16

|  |  | PG9 | PG16 | b12 | 2G12 | 2F5 | 4E10 |
|---|---|---|---|---|---|---|---|
| Clade A | 94UG103 | 3.3736 | 1.5915 | 47.29 | >50 | 46.63 | >50 |
|  | 92RW020 | 6.5462 | >50 | >50 | 6.23 | 27.74 | 36.11 |
|  | 93UG077 | >50 | >50 | >50 | >50 | 33.44 | >50 |
| Clade B | 92BR020 | >50 | >50 | >50 | 24.09 | >50 | >50 |
|  | APV-13 | >50 | >50 | >50 | N/A | N/A | N/A |
|  | APV-17 | >50 | >50 | >50 | N/A | N/A | N/A |
|  | APV-6 | 1.9591 | 44.2600 | >50 | N/A | N/A | N/A |
|  | JRCSF | <0.0025 | 0.0130 | 1.17 | 5.38 | 25.31 | 44.07 |
| Clade C | 93IN905 | 1.8945 | >50 | >50 | >50 | >50 | 12.82 |
|  | IAVI-C18 | 0.8659 | 0.2074 | >50 | >50 | N/A | >50 |
|  | IAVI-C22 | >50 | >50 | 29.6187 | >50 | >50 | 16.405 |
|  | IAVI-C3 | >50 | >50 |  | >50 | N/A | N/A |
| Clade D | 92UG024 | >50 | >50 | >50 | 7.57 | 34.44 | 23.71 |
|  | 92UG005 | >50 | >50 | >50 | >50 | >50 | >50 |
| CRF01_AE | 92TH021 | 1.9871 | 23.4110 | >50 | >50 | 18.78 | 23.52 |
|  | CMU02 | >50 | >50 | 34.2 | >50 | 12.25 | 13.4 |
| Pos C | NL43 | N/A | >50 | 0.28 | 15.75 | 19.32 | 29.56 |
| Neg C | aMLV | >50 | >50 | >50 | >50 | >50 | >50 |

NA—Not Applicable
IC$_{90}$: Inhibitory concentration to inhibit 90% of the virus
***Plateau effect Example 5: Binding Specificity of Monoclonal Antibodies for HIV gp120 by ELISA Assay The purified anti-gp120 monoclonal antibodies, 1456_P20 (PG20), 1460_G14 (PGG14), and 1495_C14 (PGC14), were confirmed for binding reactivity to gp120 in ELISA assays. When titrated in serial dilutions, all three antibodies exhibited similar binding profiles that suggest significantly higher relative avidity than control anti-gp120 (b12). MAb b12 is directed against an epitope overlapping the CD4 binding site. (Burton D R et al. 1994. Efficient neutralization of primary isolates of HIV-1 by a recombinant human monoclonal antibody. Science 266:1024-1027).

FIG. 5 shows dose response curves of 1456_P20 (PG20), 1460_G14 (PGG14), and 1495_C14 (PGC14) binding to recombinant gp120 in ELISA as compared to control anti-gp120 (b12). Data shown represented average OD values of triplicate ELISA wells obtained on the same plate.

The monoclonal antibodies 1443_C16 (PG16) and 1496_S09 (PG9) were tested for binding to soluble recombinant envelope proteins derived from several HIV strains in ELISA assay. ELISA assays were performed as described in Pantophlet, R., et al. *J Virol* 77, 642-658 (2003). For antigen binding ELISAs, serial dilutions of PG9 were added to antigen coated wells and binding was probed with alkaline phosphatase-conjugated goat anti-human immunoglobulin G (IgG) F(ab')2 Ab (Pierce). For competition ELISAs, competitor mAbs were added to ELISA wells and incubated for 15 min prior to adding 15 μg/mL biotinylated PG9 to each well. Biotinylated PG9 was detected using alkaline phosphatase conjugated streptavidin (Pierce) and visualized using p-nitrophenol phosphate substrate (Sigma). HIV-HXB2 gp120 was used for competition ELISA assays.

FIG. 6 shows results from ELISA binding assays of monoclonal antibodies 1443_C16 (PG16) and 1496_C09 (PG9) to HIV-1 YU2 gp140, JR-CSFgp120, membrane-proximal external regions (MPER) peptide of gp41 and V3 polypeptide. Specificity of the monoclonal antibodies 1443_C16 (PG16) and 1496_C09 (PG9) for gp120 was then confirmed, but it was noted that the binding to soluble envelope glycoprotein was weak.

Example 6: Binding Reactivity of Monoclonal Antibodies 1443_C16 (PG16) and 1496_C09 (PG9) to Envelope Proteins Expressed on Transfected Cell Surface and Competition by Soluble CD4 (sCD4)

MAb cell binding assays were performed as described in Pancera, M. & Wyatt, R. *Virology* 332, 145-156 (2005). Titrating amounts of PG9 and PG16 were added to HIV-1

Env transfected 293T cells, incubated for 1 hr at 4° C., washed with FACS buffer, and stained with goat anti-human IgG F(ab')$_2$ conjugated to phycoerythin. For competition assays, competitor antibodies were added to the cells 15 min prior to adding 0.1 µg/mL biotinylated PG9 or PG16. For sCD4 inhibition assays, 40 µg/mL sCD4 was added to the cells and incubated for 1 h at 4° C. prior to adding titrating amounts of antibodies. Binding was analyzed using flow cytometry, and binding curves were generated by plotting the mean fluorescence intensity of antigen binding as a function of antibody concentration.

Ninety-six-well ELISA plates were coated overnight at 4° C. with 50 µL PBS containing 100 ng gp120 or gp140 per well. The wells were washed four times with PBS containing 0.025% Tween 20 and blocked with 3% BSA at room temperature for 1 h. Serial dilutions of PG9 were added to antigen coated wells, incubated for 1 h at room temperature, and washed 4× with PBS supplemented with 0.025% Tween 20. Binding was probed with alkaline phosphatase-conjugated goat anti-human immunoglobulin G (IgG) F(ab')2 Ab (Pierce) diluted 1:1000 in PBS containing 1% BSA and 0.025% Tween 20. The plate was incubated at room temperature for 1 h, washed four times, and the plate was developed by adding 50 µL of alkaline phosphatase substrate (Sigma) to 5 mL alkaline phosphatase staining buffer (pH 9.8), according to the manufacturer's instructions. The optical density at 405 nm was read on a microplate reader (Molecular Devices). For competition ELISAs, competitor mAbs were added to gp120$_{HxB2}$ or gp140$_{YU2}$ coated ELISA wells and incubated for 15 min prior to adding 15 µg/mL biotinylated PG9 to each well. Biotinylated PG9 was detected using alkaline phosphatase conjugated streptavidin (Pierce) and visualized using p-nitrophenol phosphate substrate (Sigma). For sCD4 inhibition ELISAs, 5 µg/mL sCD4 was added to antigen-coated wells and incubated for 15 min at room temperature prior to adding titrating amounts of PG9. A FACSArray™ plate reader (BD Biosciences, San Jose, Calif.) was used for flow cytometric analysis and FlowJo™ software was used for data interpretation.

HIV gp160 derived from YU2 was transfected in 293 cells. Binding of monoclonal antibodies 1443_C16 (PG16) and 1496_C09 (PG9) were detected in transfected cells (FIG. 7). The preincubation of transfected cells with soluble CD4 (sCD4) partially inhibited binding of monoclonal antibody for 1496_C09 (PG9), and for 1443_C16 (PG16) suggesting that antibody binding is effected by the presence of sCD4. Binding is inhibited by at least 15%, at least 20%, at least 25%, or at least 30%. Binding of monoclonal antibodies 1443_C16 (PG16) and 1496_C09 (PG9) to 293 cells transfected with gp160 derived from JR-CSF and ADA strains was also detected (FIG. 8). The binding of both monoclonal antibodies 1443_C16 (PG16) and 1496_C09 (PG9) to JR-CSF transfected cells was blocked by sCD4. Results further confirm that binding activities of monoclonal antibodies 1443_C16 (PG16) and 1496_C09 (PG9) are affected by the presence of sCD4.

Example 7: Binding Reactivity of Monoclonal Antibodies 1443_C16 (PG16) and 1496_C09 (PG9) to Pseudoviruses In vitro virus capture assay was used to test if monoclonal antibodies 1443_C16 (PG16) and 1496_C09 (PG9) bind to intact entry competent pseudoviruses. The monoclonal antibodies 1443_C16 (PG16) and 1496_C09 (PG9) were coated at the bottom of 96-well plate via anti-human Fc. JR-CSF pseudovirus was added and captured by the monoclonal antibody 1443_C16 (PG16) or 1496_C09 (PG9) in a dose dependent manner. Target cells were added to initiate infection. Infection measured in RLU then represented the binding and capture activity of monoclonal antibodies 1443_C16 (PG16) and 1496_C09 (PG9). FIG. 9 shows the binding and capture of JR-CSF pseudovirus by both monoclonal antibodies 1443_C16 (PG16) and 1496_C09 (PG9) in a dose dependent manner, which is similar or better than another known broad and potent neutralizing antibody 2G12.

Example 8: Monoclonal Antibodies 1443_C16 (PG16) and 1496_C09 (PG9) Cross-Compete with Each Other and with sCD4 in Binding to JR-CSF Pseudovirus In a competition version of virus capture assay where JR-CSF pseudovirus was captured by monoclonal antibodies 1443_C16 (PG16), competition of the capture by either monoclonal antibodies 1443_C16 (PG16), 1496_C09 (PG9) and sCD4 was measured. FIG. 10B shows that binding of monoclonal antibody 1443_C16 (PG16) to JR-CSF pseudovirus was blocked by itself, monoclonal antibody 1496_C09 (PG9) and sCD4 in a dose dependent manner. In a corresponding manner, FIG. 10B shows that binding of monoclonal antibody 1496_C09 (PG9) to JR-CSF pseudovirus was blocked by itself, monoclonal antibody 1443_C16 (PG16) and sCD4 in a dose dependent manner. Results indicated that the monoclonal antibodies 1443_C16 (PG16) and 1496_C09 (PG9) bind to closely related epitopes on gp120 and their binding is affected by the presence of sCD4 presumably due to conformational changes induced on HIV-1 envelope by sCD4.

Example 9: Antigen Binding Properties of PG9 and PG16

Antigen binding properties of PG9 and PG16 were determined by ELISA assays as shown in FIG. 11A-B. Binding of PG9 and PG16 to monomeric gp120 and artificially trimerized gp140 constructs were determined (FIG. 11A). Binding of PG9 and PG16 to Env expressed on the surface of 293T cells as determined by flow cytometry. (FIG. 11B). b12 was used as a control for ELISA assays. The bNAb b12 and the non-neutralizing antibody b6 were included in the cell surface binding assays to show the expected percentages of cleaved and uncleaved Env expressed on the cell surface.

Example 10: Binding of PG9 and PG16 to Cleavage-Defective HIV-1$_{YU2}$ Trimers Binding of PG9 and PG16 to cleavage-defective HIV-1$_{YU2}$ trimers was determined by flow cytometry. PG9 and PG16 bind with high affinity to cleavage-defective HIV-1$_{YU2}$ trimers as shown in FIG. 12. Binding curves were generated by plotting the mean fluorescence intensity (MFI) of antigen binding as a function of antibody concentration.

Example 11: Mapping the PG9 and PG16 Epitopes

Mapping the epitopes of PG9 and PG16 epitopes was performed by a competitive binding assay as shown in FIG. 13.PG9 and PG16 competed with each other for cell surface Env binding and neither antibody competed with the CD4bs antibody b12 for Env binding. Competitor antibody is indicated at the top of each graph. (FIG. 13A). Ligation of cell surface Env with sCD4 diminished binding of PG9 and PG16. 2G12 was included to control for CD4-induced shedding of gp120. (FIG. 13B). sCD4 inhibited binding of PG9 to artificially trimerized gp140$_{JR-CSF}$ as determined by ELISA. (FIG. 13C). PG9 competed with 10/76b (anti-V2), F425/b4e8 (anti-V3) and X5 (CD4i) for gp120 binding in competition ELISA assays. (FIG. 13D). PG9 and PG16 failed to bind variable loop deleted HIV-1JR-csF variants expressed on the surface of 293T cells. 2G12 was included to control for cell surface Env expression. (FIG. 13E).

Example 12: Competition ELISA Assays Using PG9

When competition ELISA assays using PG9 were performed, PG9 competed with c108g (anti-V2) and partially competed with 17b (CD4i). No competition was observed with A32 (anti-C1/C2/C4/CD4i), C11 (C1), 2G12 (glycan shield), b6 (CD4bs), b3 (CD4bs) or 23b (C1/C5) for gp120$_{HxB2}$ binding as shown in FIG. 14.

Example 13: Binding of PG9 and PG16 to HIV-1$_{JR-FL}$ E168K

Antibody binding to HIV-1JR-FLΔCT E168K Env expressed on the surface of 293T cells as determined by flow cytometry is shown in FIG. 15. A cytoplasmic tail deleted construct was used to increase cell surface expression. The bNAb b12 and the non-neutralizing antibody b6 were included in the cell surface binding assays to show the expected percentages of cleaved and uncleaved Env expressed on the cell surface. (Pancera M., et al. *Virology* 332:145 (2005). HIV-1JR-FL E168K was generated by site-directed mutagenesis. Binding curves were generated by plotting the MFI of antigen binding as a function of antibody concentration.

Example 14: PG9 Binding to Deglycosylated Gp120 gp120$_{DU422}$ was treated with 40 mU/μg Endoglycosidase H (Endo H, New England Biolabs) in sodium acetate buffer for 24 hr at 37° C. Mock treated gp120 was treated under same conditions, but the enzyme was omitted from the reaction. Binding of PG9 and b6 to EndoH treated and mock treated gp120 was determined by ELISA as shown in FIG. 16.

Example 15: Neutralization Activity Against HIV-1$_{SF162}$ K160N

Neutralization activity of PG9 and PG16 against HIV-1$_{SF162}$ and HIV-1$_{SF162}$ K160N was determined using a single-round replication luciferase reporter assay of pseudotyped virus. HIV-1$_{SF162}$ K160N was generated by site-directed mutagenesis as shown in FIG. 17.

Example 16: Binding of PG9 and PG16 to Mixed Trimers

Alanine substitutions at positions 160 and 299 were introduced into HIV-1$_{YU2}$ Env to abolish binding of PG9 and PG16. An alanine substitution at position 295 was also introduced into the same construct to abrogate binding of 2G12. Co-transfection of 293T cells with WT and mutant plasmids in a 1:2 ratio resulted in the expression of 29% mutant homotrimers, 44% heterotrimers with two mutant subunits, 23% heterotrimers with one mutant subunit, and 4% wild-type homotrimers. These proportions were calculated using the formula described in Yang, X., Kurteva, S., Lee, S., and J. Sodroski, J Virol 79(6):3500-3508 (March 2005), and assumes that mutant and wild-type gp120s mix randomly to form trimers. Binding of mAbs to Env trimers was determined by flow cytometry as shown in FIG. 18. b12 was included as control for Env cell surface expression.

Example 17: PG9 or PG16 Neutralization Activity on HIV with Alanine Mutations within gp120

Alanine mutations within gp120 of HIV decrease PG9 or PG16 neutralization activity as shown in Table 21. In the table, amino acid numbering is based on the sequence of HIV-1$_{HxB2}$. Amino acid identity was determined based on a sequence alignment of HIV-1 isolates listed in the HIV sequence database at hiv-web.lanl.gov/content/hiv-db/mainpage.html. C refers to constant domains and V refers to variable loops. Neutralization activity is reported as fold increase in IC$_{50}$ value relative to WT JR-CSF and was calculated using the equation (IC$_{50}$ mutant/IC$_{50}$ WT). Experiments were performed in triplicate and values represent an average of at least three independent experiments.

TABLE 18A

| | | IC50 (μg/ml)[a] | | | | | | | IC50 (1/Dil'n)[b] Donor |
|---|---|---|---|---|---|---|---|---|---|
| Clade | Virus | b12 | 2G12 | 2F5 | 4E10 | PG9 | PG16 | PGC14 | Serum |
| A | MGRM-A-001 | >50 | >50 | >50 | 15.08 | >50 | >50 | >50 | <100 |
|   | MGRM-A-002 | >50 | >50 | >50 | 6.45 | 0.02 | 0.004 | >50 | 804 |
|   | MGRM-A-003 | >50 | >50 | 7.37 | 5.94 | 0.65 | 2.65 | >50 | <100 |
|   | MGRM-A-004 | >50 | >50 | 7.49 | 3.14 | 0.02 | 0.04 | >50 | 523 |
|   | MGRM-A-005 | 3.64 | >50 | 5.70 | 4.09 | 0.28 | 0.09 | >50 | 175 |
|   | MGRM-A-006 | 13.62 | 13.75 | 15.73 | 9.87 | >50 | >50 | >50 | 131 |
|   | MGRM-A-007 | >50 | >50 | 16.33 | 1.82 | 0.37 | 5.91 | >50 | 142 |
|   | MGRM-A-008 | >50 | >50 | >50 | 7.59 | >50 | >50 | >50 | 142 |
|   | MGRM-A-009 | 4.34 | 7.47 | 9.40 | 12.01 | 0.03 | 0.01 | >50 | 941 |
|   | MGRM-A-010 | >50 | 17.01 | 20.75 | 14.44 | 0.02 | 0.004 | >50 | 1430 |
|   | MGRM-A-011 | 4.01 | >50 | >50 | 2.88 | 0.02 | 0.24 | >50 | 404 |
|   | MGRM-A-012 | >50 | >50 | 2.36 | 4.27 | 11.18 | 20.72 | >50 | <100 |
|   | MGRM-A-013 | 7.04 | >50 | 0.66 | 1.46 | 0.16 | 0.09 | >50 | 350 |
|   | MGRM-A-014 | >50 | >50 | 1.43 | 1.74 | 0.62 | 20.33 | >50 | 158 |
|   | 94UG103 | 6.92 | 48.12 | 1.92 | 4.97 | 0.24 | 0.04 | >50 | 350 |
|   | 92RW020 | >50 | 0.48 | 3.36 | 4.54 | 0.08 | 0.28 | 46 | 282 |
|   | 93UG077 | 46.95 | >50 | 3.30 | 10.60 | >50 | >50 | >50 | 206 |

TABLE 18A-continued

| Clade | Virus | IC50 (μg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| | 94KE105 | >50 | 7.22 | >50 | 7.63 | 29.56 | 6.13 | >50 | <100 |
| | 93RW029 | >50 | >50 | >50 | 15.52 | 1.19 | 3.83 | 42 | 256 |
| | 92RW009 | >50 | 26.14 | 39.08 | >50 | 0.03 | 0.11 | >50 | 254 |
| | 92UG031 | >50 | >50 | 3.81 | 4.94 | 3.08 | 0.43 | >50 | 259 |
| | 92RW026 | >50 | 17.20 | 8.63 | 12.88 | 0.27 | 0.03 | >50 | 361 |
| | 92UG037 | >50 | 45.24 | 3.24 | 8.84 | 0.02 | 0.01 | >50 | 1252 |
| | 92RW008 | 9.46 | 22.47 | 10.41 | 14.53 | 0.01 | 0.002 | 37 | 4067 |
| | 92RW021* | >50 | >50 | 4.16 | 4.87 | 0.05 | 0.11 | >50 | 316 |
| | VLGCA1 | >50 | >50 | 3.90 | 4.58 | 0.07 | 0.18 | >50 | 197 |
| | 92RW024 | >50 | >50 | 8.22 | 8.88 | 0.18 | 0.08 | >50 | 241 |

TABLE 18B

| Clade | Virus | IC50 (μg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| B | 6535.3 (Acute) | 1.93 | 3.85 | 2.76 | 1.23 | 0.22 | 36.88 | 35 | 387 |
| | QH0692.42 (Acute) | 0.73 | 4.39 | 5.42 | 12.67 | >50 | >50 | >50 | <100 |
| | SC422661.8 (Acute) | 6.11 | 0.84 | >50 | 6.35 | 0.79 | 1.13 | >50 | 182 |
| | PVO.4 (Acute) | >50 | 0.80 | >50 | 18.32 | 4.01 | 5.43 | >50 | 171 |
| | TRO.11 (Acute) | >50 | 0.29 | >50 | 1.39 | 5.43 | 0.22 | >50 | 222 |
| | CAAN.A2 (Acute) | >50 | >50 | 23.05 | 17.89 | 5.67 | 8.83 | >50 | <100 |
| | TRJ0.58 (Acute) | >50 | >50 | >50 | 11.94 | 0.43 | 1.16 | >50 | 171 |
| | THR0.18 (Acute) | 3.62 | >50 | >50 | 4.68 | 12.39 | 1.34 | >50 | <100 |
| | 92BR020 | >50 | 4.84 | >50 | >50 | >50 | >50 | 4 | <100 |
| | APV_13 | >50 | 9.24 | 3.81 | 7.33 | >50 | >50 | >50 | <100 |
| | APV_17 | >50 | >50 | 4.61 | 10.53 | 14.59 | 24.78 | >50 | <100 |
| | APV_6 | >50 | 1.90 | 0.25 | 1.10 | 0.12 | 0.29 | 23 | 394 |
| | 93TH305 | 4.17 | 0.55 | 7.61 | 12.33 | 2.08 | 19.34 | 6 | 133 |
| | VLGCB3 | 0.15 | 7.90 | >50 | 5.76 | 0.02 | 0.40 | 21 | 244 |
| | JRCSF | 0.21 | 0.37 | 1.85 | 3.30 | 0.003 | 0.001 | 15 | 8425 |
| | NL43 | 0.17 | 0.49 | 2.02 | 4.67 | 0.32 | 0.02 | 40 | 1488 |
| | MGRM-Chronic-B-001 | 0.75 | 0.08 | 0.55 | 1.46 | >50 | >50 | >50 | <100 |
| | MGRM-Chronic-B-002 | 0.86 | >50 | 1.25 | 2.19 | 1.41 | 3.06 | >50 | 220 |
| | MGRM-Chronic-B-003 | >50 | 0.06 | 1.00 | 3.50 | 50.00 | 0.19 | >50 | 280 |
| | MGRM-Chronic-B-004 | 0.26 | 8.65 | 2.41 | 3.70 | 0.11 | 0.01 | >50 | 1316 |
| | MGRM-Chronic-B-008 | 2.82 | 0.55 | >50 | 16.70 | 6.66 | 0.73 | >50 | 140 |
| | MGRM-Chronic-B-010 | >50 | 1.50 | 0.96 | 1.69 | 0.004 | 0.01 | 27 | 1640 |
| | MGRM-Chronic-B-011 | 2.11 | >50 | 0.81 | 1.07 | >50 | >50 | >50 | 249 |
| | MGRM-Chronic-B-012 | >50 | 0.22 | 17.65 | 48.05 | 0.91 | 3.74 | >50 | 304 |
| | MGRM-Chronic-B-017 | 2.59 | >50 | >50 | 2.77 | 0.32 | 0.02 | >50 | 644 |
| | MGRM-Chronic-B-018 | 0.66 | >50 | 10.80 | 23.19 | 0.16 | 0.70 | >50 | 180 |
| | MGRM-Chronic-B-020 | 6.16 | 0.20 | 0.78 | 2.45 | >50 | >50 | >50 | <100 |
| | MGRM-Chronic-B-023 | >50 | 0.16 | 0.10 | 27.92 | 0.04 | 0.13 | >50 | 286 |
| | MGRM-Chronic-B-024 | >50 | >50 | >50 | 9.19 | 0.18 | 0.01 | >50 | 884 |
| | JRFL | 0.02 | 1.45 | 3.54 | 18.91 | >50 | >50 | >50 | <100 |
| | SF162 | 0.02 | 1.67 | 2.52 | 4.28 | >50 | >50 | <0.0025 | 9777 |

TABLE 18C

| Clade | Virus | IC50 (μg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| C | MGRM-C-001 | >50 | 2.93 | >50 | 5.66 | >50 | 16.79 | >50 | 175 |
| | MGRM-C-002 | >50 | >50 | 44.68 | 18.19 | >50 | 28.30 | >50 | <100 |
| | MGRM-C-004 | 5.46 | >50 | >50 | 24.24 | 1.18 | 5.09 | >50 | 183 |
| | MGRM-C-005 | 2.66 | >50 | >50 | 16.41 | 2.98 | 2.55 | >50 | 306 |
| | MGRM-C-006 | >50 | >50 | >50 | 4.94 | 0.23 | 2.62 | >50 | 224 |
| | MGRM-C-007 | >50 | >50 | >50 | 5.84 | 0.09 | 0.05 | >50 | 598 |
| | MGRM-C-008 | 1.51 | >50 | >50 | 2.97 | >50 | >50 | >50 | 160 |
| | MGRM-C-009 | >50 | >50 | >50 | 0.56 | >50 | >50 | >50 | <100 |
| | MGRM-C-010 | >50 | >50 | >50 | 10.96 | 12.45 | >50 | >50 | <100 |
| | MGRM-C-012 | >50 | >50 | >50 | 0.44 | 0.24 | 0.48 | >50 | 432 |
| | MGRM-C-013 | >50 | >50 | 18.35 | 2.10 | >50 | >50 | >50 | 105 |
| | MGRM-C-014 | >50 | >50 | >50 | 2.48 | 0.64 | >50 | >50 | 124 |
| | MGRM-C-015 | 13.30 | 1.75 | >50 | 2.52 | 0.50 | 0.26 | >50 | 365 |
| | MGRM-C-017 | >50 | >50 | >50 | 1.47 | 1.52 | 1.80 | >50 | 190 |
| | MGRM-C-019 | >50 | >50 | >50 | 3.49 | 0.01 | 0.002 | 12 | 6894 |
| | MGRM-C-020 | >50 | 18.58 | >50 | 2.80 | >50 | >50 | >50 | <100 |
| | MGRM-C-022 | >50 | >50 | >50 | 5.71 | 0.19 | 0.25 | >50 | 126 |
| | MGRM-C-023 | 13.88 | >50 | >50 | 1.95 | 0.51 | 0.09 | >50 | 220 |
| | MGRM-C-024 | >50 | >50 | >50 | 22.61 | 0.22 | 0.04 | >50 | 494 |
| | MGRM-C-025 | >50 | >50 | >50 | 5.58 | 0.17 | 0.04 | >50 | 434 |
| | 93IN905 | 21.38 | >50 | >50 | 1.26 | 0.03 | 0.25 | 19 | 647 |
| | LAVIC_18 | >50 | >50 | >50 | >50 | 0.10 | 0.02 | >50 | 577 |
| | LAVI_C22 | 7.64 | >50 | >50 | 2.02 | 0.14 | 0.02 | 25 | 1002 |
| | LAVI_C3 | 0.94 | >50 | >50 | 2.85 | 1.45 | 9.55 | 12 | 443 |
| | 98IN022 | 0.42 | >50 | >50 | 0.53 | 0.006 | 0.003 | 9 | 2708 |
| | 93MW959 | >50 | >50 | >50 | 4.55 | 0.04 | 0.007 | >50 | 976 |
| | 97ZA012 | >50 | >50 | >50 | 4.70 | 1.27 | 2.55 | >50 | 188 |
| CRF08BC | 98CN006 | >50 | >50 | >50 | 1.91 | >50 | >50 | >50 | 397 |
| CRF07BC | 98CN009 | 1.52 | >50 | >50 | 2.46 | 1.07 | 5.76 | 43 | 289 |

TABLE 18D

| Clade | Virus | IC50 (μg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| D | MGRM-D-001 | >50 | >50 | 0.63 | 1.84 | >50 | >50 | >50 | <100 |
| | MGRM-D-002 | >50 | >50 | 24.64 | 9.44 | 0.027 | 0.01 | 29 | 515 |
| | MGRM-D-003 | >50 | >50 | >50 | 2.49 | 0.02 | 0.01 | >50 | 363 |
| | MGRM-D-004 | >50 | >50 | 2.30 | 1.58 | 0.03 | 0.01 | >50 | 616 |
| | MGRM-D-005 | >50 | 25.66 | >50 | 35.16 | 0.59 | 19.66 | >50 | <100 |
| | MGRM-D-008 | >50 | >50 | >50 | 42.90 | 6.86 | >50 | >50 | <100 |
| | MGRM-D-011 | 7.75 | 1.50 | >50 | 0.91 | 0.06 | 0.01 | >50 | 298 |
| | MGRM-D-012 | 0.13 | >50 | 1.70 | 1.13 | 9.31 | 0.35 | >50 | <100 |
| | MGRM-D-013 | >50 | >50 | 2.12 | 5.38 | 0.06 | 0.11 | >50 | <100 |
| | MGRM-D-014 | >50 | >50 | 2.22 | 3.24 | 0.02 | 0.003 | 48 | 5127 |
| | MGRM-D-016 | 1.12 | >50 | 9.85 | 15.45 | 0.10 | 0.02 | >50 | 364 |
| | MGRM-D-018 | 1.39 | 0.12 | 4.05 | 3.90 | 0.02 | 0.004 | >50 | 883 |
| | MGRM-D-019 | >50 | >50 | 0.14 | 0.04 | 0.03 | 0.01 | >50 | 497 |
| | MGRM-D-020 | >50 | >50 | >50 | >50 | 2.03 | 16.27 | >50 | <100 |
| | MGRM-D-021 | 5.23 | 22.98 | >50 | 13.26 | >50 | >50 | >50 | <100 |
| | MGRM-D-022 | 17.63 | >50 | 8.45 | 16.92 | >50 | >50 | >50 | <100 |

TABLE 18D-continued

| Clade | Virus | IC50 (µg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| | MGRM-D-024 | 5.92 | >50 | >50 | 3.60 | 0.03 | 0.02 | >50 | 239 |
| | MGRM-D-026 | 1.55 | >50 | 4.37 | 2.95 | 17.51 | >50 | >50 | <100 |
| | MGRM-D-028 | 0.78 | >50 | >50 | 1.28 | 4.39 | >50 | >50 | <100 |
| | MGRM-D-029 | >50 | >50 | >50 | 5.30 | >50 | >50 | >50 | <100 |
| | 92UG024 | 45.64 | 0.42 | 0.95 | 2.17 | 1.91 | 23.98 | >50 | 112 |
| | 92UG005 | >50 | >50 | 8.61 | 7.46 | >50 | >50 | >50 | <100 |
| | 92UG046 | 0.07 | >50 | >50 | 12.15 | 0.64 | 1.42 | >50 | 114 |
| | 92UG001 | 1.01 | >50 | 12.98 | 13.58 | 41.79 | >50 | >50 | <100 |
| | 94UG114 | >50 | 13.92 | >50 | 9.72 | >50 | >50 | >50 | <100 |

TABLE 18E

| Clade | Virus | IC50 (µg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| CRF01_AE | MGRM-AE-001 | 25.95 | >50 | 0.29 | 0.85 | 2.97 | 4.33 | >50 | <100 |
| | MGRM-AE-002 | 17.10 | >50 | 0.31 | 0.55 | 0.04 | 0.01 | >50 | 653 |
| | MGRM-AE-003 | >50 | >50 | 0.24 | 0.34 | 0.02 | 0.03 | >50 | 211 |
| | MGRM-AE-004 | >50 | >50 | 0.98 | 1.27 | 0.01 | 0.002 | >50 | 1773 |
| | MGRM-AE-005 | 0.63 | >50 | 0.14 | 0.47 | 0.16 | 0.02 | >50 | 233 |
| | MGRM-AE-006 | >50 | >50 | 0.18 | 0.23 | 0.05 | 0.03 | >50 | 151 |
| | MGRM-AE-007 | >50 | >50 | 0.07 | 0.45 | 0.11 | 0.04 | >50 | 176 |
| | MGRM-AE-008 | >50 | >50 | >50 | 0.94 | 10.58 | 3.25 | >50 | 141 |
| | 92TH021 | N/A | >50 | N/A | 1.17 | 0.09 | 0.10 | >50 | 192 |
| | CMU02 | 29.32 | >50 | 0.60 | 0.72 | 7.69 | 43.63 | >50 | 142 |
| CRF_AG | MGRM-AG-001 | 11.87 | 0.69 | 0.75 | 1.12 | 8.83 | 0.03 | >50 | 388 |
| | MGRM-AG-002 | 0.89 | 0.54 | 0.54 | 0.80 | 0.04 | 0.03 | >50 | 147 |
| | MGRM-AG-003 | >50 | >50 | 0.14 | 0.64 | 9.71 | >50 | >50 | <100 |
| | MGRM-AG-005 | >50 | >50 | >50 | 2.13 | 29.67 | >50 | >50 | 150 |
| | MGRM-AG-006 | >50 | 3.92 | 0.85 | 1.76 | >50 | >50 | >50 | <100 |
| | MGRM-AG-008 | >50 | >50 | 0.54 | 1.48 | 0.02 | 0.002 | 45 | 1518 |
| | MGRM-AG-009 | >50 | >50 | 24.80 | 31.39 | >50 | >50 | >50 | <100 |
| | MGRM-AG-011 | >50 | >50 | >50 | 1.36 | 0.01 | 0.002 | >50 | 1427 |
| | MGRM-AG-012 | 10.40 | 1.94 | 0.33 | 0.86 | 1.37 | 25.13 | >50 | <100 |
| | MGRM-AG-013 | >50 | 0.95 | 1.79 | 2.61 | 0.23 | 0.31 | >50 | <100 |
| G | MGRM-G-001 | >50 | >50 | 4.1 | 2.04 | 0.16 | 0.15 | >50 | <100 |
| | MGRM-G-004 | >50 | >50 | >50 | 1.47 | >50 | >50 | >50 | <100 |
| | MGRM-G-006 | >50 | >50 | 1.33 | 1.23 | 0.51 | 2.42 | >50 | 116 |
| | MGRM-G-009 | >50 | >50 | 7.21 | 1.34 | 4.90 | >50 | >50 | <100 |
| | MGRM-G-011 | >50 | >50 | 1.16 | 1.44 | 0.19 | 0.04 | >50 | 150 |

TABLE 18E-continued

| Clade | Virus | IC50 (μg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| | MGRM-G-013 | >50 | >50 | 0.59 | 1.15 | >50 | >50 | >50 | <100 |
| | MGRM-G-014 | >50 | >50 | 9.65 | 13.67 | 6.32 | 6.98 | >50 | <100 |
| | MGRM-G-015 | >50 | >50 | 0.43 | 1.07 | 1.51 | 5.33 | >50 | <100 |
| | MGRM-G-016 | >50 | >50 | 16.82 | 1.02 | 0.40 | 11.35 | >50 | <100 |
| | MGRM-G-017 | >50 | >50 | 0.60 | 1.14 | 0.03 | 0.02 | >50 | 453 |
| | MGRM-G-019 | 3.77 | 31.03 | >50 | 6.53 | 0.67 | 1.21 | >50 | <100 |
| | MGRM-G-024 | 2.38 | >50 | 1.07 | 1.57 | 0.07 | 0.01 | >50 | 236 |
| | MGRM-G-025 | >50 | 31.94 | >50 | 1.70 | >50 | >50 | >50 | <100 |
| | MGRM-G-027 | >50 | >50 | 0.28 | 1.19 | 0.01 | 0.01 | >50 | 351 |
| | MGRM-G-028 | >50 | 28.25 | 2.24 | 6.32 | 0.13 | 3.09 | >50 | <100 |

TABLE 18F

| Clade | Virus | IC50 (μg/ml)[a] | | | | | | | IC50 (1/Dil'n)[b] Donor Serum |
|---|---|---|---|---|---|---|---|---|---|
| | | b12 | 2G12 | 2F5 | 4E10 | PG9 | PG16 | PGC14 | |
| F | MGRM-F1-004 | >50 | >50 | 4.31 | 2.74 | 0.11 | 0.43 | >50 | 104 |
| | MGRM-F1-006 | >50 | >50 | 1.10 | 1.01 | 1.45 | 0.27 | >50 | <100 |
| | MGRM-F1-008 | >50 | >50 | 1.61 | 2.75 | >50 | >50 | >50 | <100 |
| | MGRM-F1-010 | >50 | N/A | 14.56 | 3.69 | 0.03 | 0.01 | >50 | 634 |
| | MGRM-F1-012 | >50 | 1.81 | >50 | 0.37 | 0.01 | 0.003 | >50 | 866 |
| | MGRM-F1-013 | >50 | >50 | 4.57 | N/A | 0.56 | N/A | 6 | 142 |
| | MGRM-F1-014 | >50 | >50 | 15.13 | 7.36 | 0.01 | 0.01 | >50 | 437 |
| | MGRM-F1-015 | >50 | >50 | 0.10 | 0.53 | >50 | >50 | >50 | <100 |
| | MGRM-F1-016 | >50 | >50 | 21.47 | 7.61 | 0.58 | 1.12 | >50 | <100 |
| | MGRM-F1-017 | >50 | >50 | >50 | 4.92 | >50 | >50 | >50 | <100 |
| | MGRM-F1-018 | >50 | >50 | 3.91 | 3.60 | 0.03 | 0.01 | >50 | 432 |
| | MGRM-F1-020 | >50 | >50 | 0.59 | 0.66 | 4.55 | 4.35 | >50 | <100 |
| | MGRM-F1-021 | >50 | 14.09 | 1.37 | 1.87 | >50 | >50 | 46 | <100 |
| | MGRM-F1-022 | >50 | >50 | 1.26 | 1.01 | 0.06 | 0.08 | >50 | 246 |
| | MGRM-F1-023 | >50 | 9.23 | 1.78 | 0.44 | >50 | >50 | >50 | 101 |
| neg. control | aMLV | >50 | >50 | >50 | >50 | >50 | >50 | >50 | <100 |

TABLE 19A

Neutralization Potency.

| Clade[a] | # viruses | Median IC$_{90}$ (μg/mL) against viruses neutralized with an IC$_{90}$ <50 μg/ml | | | | | | |
|---|---|---|---|---|---|---|---|---|
| | | b12 | 2G12 | 2F5 | 4E10 | PG9 | PG16 | PGC14 |
| A | 27 | 48.45 | 17.77 | 28.82 | 40.62 | 0.99 | 0.81 | >50 |
| B | 31 | 2.30 | 4.65 | 25.85 | 32.38 | 0.11 | 0.01 | 9.45 |
| C | 27 | 28.41 | 28.67 | >50 | 23.37 | 2.94 | 5.10 | >50 |
| D | 25 | 12.68 | 8.76 | 9.02 | 23.45 | 0.34 | 0.44 | >50 |
| CRF01_AE | 10 | 12.68 | >50 | 8.14 | 12.95 | 0.36 | 1.51 | >50 |
| CRF_AG | 10 | 16.97 | 7.04 | 13.49 | 15.78 | 0.28 | 1.86 | >50 |
| G | 15 | 23.62 | >50 | 17.54 | 16.67 | 1.91 | 1.96 | >50 |
| F | 15 | >50 | 21.49 | 17.77 | 7.64 | 0.25 | 0.55 | >50 |
| total | 162 | 20.30 | 13.27 | 17.54 | 23.37 | 0.36 | 1.16 | 9.45 |

*CRF_07BC and CRF_08BC viruses not included in the clade analysis because there was only one virus tested from each of these clades.

TABLE 19B

Neutralization Breadth.

| Clade[a] | # viruses | b12 | 2G12 | 2F5 | 4E10 | PG9 | PG16 | PGC14 |
|---|---|---|---|---|---|---|---|---|
| | | % viruses neutralized with an IC$_{90}$ <50 μg/ml | | | | | | |
| A | 27 | 4 | 4 | 33 | 22 | 74 | 41 | 0 |
| B | 31 | 45 | 52 | 45 | 23 | 42 | 26 | 6 |
| C | 27 | 15 | 4 | 0 | 41 | 52 | 41 | 0 |
| D | 25 | 28 | 12 | 12 | 20 | 44 | 36 | 0 |
| CRF01_AE | 10 | 11 | 0 | 67 | 70 | 60 | 60 | 0 |
| CRF_AG | 10 | 10 | 30 | 70 | 60 | 40 | 40 | 0 |
| G | 15 | 13 | 0 | 53 | 53 | 47 | 27 | 0 |
| F | 15 | 0 | 7 | 47 | 43 | 47 | 29 | 0 |
| total | 162 | 19 | 15 | 33 | 36 | 51 | 35 | 4 |
| | | % viruses neutralized with an IC$_{90}$ <1.0 μg/ml | | | | | | |
| A | 27 | 0 | 0 | 0 | 0 | 36 | 27 | 0 |
| B | 31 | 10 | 6 | 0 | 0 | 13 | 19 | 3 |
| C | 27 | 0 | 0 | 0 | 0 | 15 | 15 | 0 |
| D | 25 | 0 | 4 | 0 | 0 | 32 | 20 | 0 |
| CRF01_AE | 10 | 0 | 0 | 0 | 0 | 40 | 30 | 0 |
| CRF_AG | 10 | 0 | 0 | 0 | 0 | 30 | 10 | 0 |
| G | 15 | 0 | 0 | 0 | 0 | 13 | 7 | 0 |
| F | 15 | 0 | 0 | 0 | 0 | 33 | 21 | 0 |
| total | 162 | 2 | 2 | 0 | 0 | 25 | 18 | <1 |

*CRF_07BC and CRF_08BC viruses not included in the clade analysis because there was only one virus tested from each of these clades.

TABLE 20

Neutralization activity of PG9 and PG16 against JR-CSF pseudovirus containing alanine point mutations.

| Mutation[a,b] | gp120 domain[c] | Fold IC$_{50}$ increase relative to wild-type[d] | | Mutation[a,b] | gp120 domain[c] | Fold IC$_{50}$ increase relative to wild-type[d] | |
|---|---|---|---|---|---|---|---|
| | | PG9 | PG16 | | | PG9 | PG16 |
| W112A | C1 | 1 | 1 | P299A | V3 (base) | 200 | 1400 |
| V120A | C1 | 2 | 1 | N301A | V3 (base) | 9 | 3 |
| K121A | C1 (V1/V2 stem) | 1 | 1 | N302A | V3 (stem) | 1 | 1 |
| L122A | C1 (V1/V2 stem) | 2 | 1 | R304A | V3 (stem) | 2 | 3 |
| L125A | C1 (V1/V2 stem) | 1 | 1 | K305A | V3 (stem) | 50 | 2800 |
| V127A | C1 (V1/V2 stem) | 30 | 57 | S306A | V3 (tip) | 1 | 1 |
| N134A | V1 | 5 | 23 | I307A | V3 (tip) | 10 | 3000 |
| N156A | C1 (V1/V2 stem) | 280 | 1500 | H308A | V3 (tip) | 3 | 1 |
| S158A | C1 (V1N2 stem) | >2000 | >2000 | I309A | V3 (tip) | 9 | 150 |
| F159A | C1 (V1/V2 stem) | >2000 | >2500 | P313A | V3 (tip) | 1 | 1 |
| N160k | V2 | >2000 | >2500 | R315A | V3 (tip) | 1 | 1 |
| T162A | V2 | >2000 | >2500 | F317A | V3 (tip) | 3 | 1400 |
| I165A | V2 | 1 | 1 | Y318A | V3 (tip) | 2 | 1000 |
| R166A | V2 | 2 | 1 | T319A | V3 (tip) | 1 | 1 |
| D167A | V2 | 5 | 30 | T320A | V3 (tip) | 2 | 1 |
| K168A | V2 | 1 | 3 | E322A | V3 (stem) | 2 | 3 |
| K171A | V2 | 1 | 1 | D325A | V3 (stem) | 1 | 1 |
| E172A | V2 | 1 | 1 | H330A | V3 (base) | 1 | 1 |
| Y173A | V2 | 1400 | 1000 | N332A | V3 (base) | 1 | 1 |
| F176A | V2 | >5000 | >7000 | Q337A | C3 | 1 | 1 |
| Y177A | V2 | 1 | 5 | N339A | C3 | 1 | 1 |

TABLE 20-continued

Neutralization activity of PG9 and PG16 against JR-CSF pseudovirus containing alanine point mutations.

| Mutation[a,b] | gp120 domain[c] | Fold IC$_{50}$ increase relative to wild-type[d] | | Mutation[a,b] | gp120 domain[c] | Fold IC$_{50}$ increase relative to wild-type[d] | |
|---|---|---|---|---|---|---|---|
| | | PG9 | PG16 | | | PG9 | PG16 |
| L179A | V2 | 1 | 3 | K343A | C3 | 1 | 1 |
| D180A | V2 | 1 | 4 | R350A | C3 | 1 | 1 |
| V181A | V2 | 200 | 250 | N355A | C3 | 9 | 3 |
| V182A | V2 | 1 | 3 | S365A | C3 | 2 | 3 |
| I184A | V2 | 1 | 1 | N386A | C3 | 1 | 1 |
| D185A | V2 | 1 | 1 | T388A | C3 | 1 | 1 |
| N188A | V2 | 3 | 3 | N392A | V4 | 7 | 23 |
| T190A | V2 | 2 | 4 | W395A | V4 | 1 | 1 |
| N197K | C2 (V1/V2 stem) | 1 | 1 | R419A | C4 | 3 | 3 |
| T198A | C2 (V1/V2 stem) | 2 | 1 | I420A | C4 | 9 | 11 |
| S199A | C2 (V1/V2 stem) | 2 | 1 | K421A | C4 | 1 | 1 |
| T202A | C2 (V1V2 stem) | 1 | 1 | Q422A | C4 | 9 | 5 |
| F210A | C2 | 3 | 1 | I423A | C4 | 40 | 14 |
| I213A | C2 | 1 | 1 | I424A | C4 | 10 | 9 |
| N241A | C2 | 4 | 3 | I439A | C4 | 2 | 3 |
| N262A | C2 | 1 | 1 | T450A | C4 | 1 | 1 |
| N276A | C2 | 1 | 1 | L452A | C4 | 1 | 1 |
| N295A | C2 | 2 | 1 | P470A | V5 | 1 | 1 |
| T297A | V3 (base) | 1 | 1 | | | | |

[a]Amino acid number is based on the sequence of HIV-1$_{HxB2}$.
[b] Amino acid identity was determined based upon a sequence alignment of HIV-1 isolates listed in the HIV sequence database at http://hiv-gov/content/hiv-db/mainpage.html.
[c]C refers to constant domains and V refers to variable loops.
[d]Neutralization activity is reported as fold increase in IC50 value relative to WT JR-CSF and was calculated using the equation (IC50 mutant/ IC50 WT). White: substitutions which had a negligible effect on neutralization activity, lightest grey: 4-9 fold IC50 increase, dark grey: 10-100 fold IC50 increase, darkest grey: >100 fold IC50 increase. Experiments were performed in triplicate and values represent an average of at least three independent experiments.

TABLE 21

Alanine mutations that decrease PG9 and PG16 neutralization activity.

| Mutation[a,b] | gp120 domain[c] | Fold IC50 increase relative to wild-type[d] | |
|---|---|---|---|
| | | PG9 | PG16 |
| V127A | C1 (V1/V2 stem) | 30 | 57 |
| N134A | V1 | 5 | 23 |
| N156A | C1 (V1/V2 stem) | 280 | 1500 |
| S158A | C1 (V1/V2 stem) | >2000 | >2000 |
| F159A | C1 (V1/V2 stem) | >2000 | >2500 |
| N160K | V2 | >2000 | >2500 |
| T162A | V2 | >2000 | >2500 |
| D167A | V2 | 5 | 30 |
| Y173A | V2 | 1400 | 1000 |
| F176A | V2 | >5000 | >7000 |
| V181A | V2 | 200 | 250 |
| P299A | V3 (base) | 200 | 1400 |
| K305A | V3 (stem) | 50 | 2800 |
| I307A | V3 (tip) | 10 | 3000 |
| I309A | V3 (tip) | 9 | 150 |
| F317A | V3 (tip) | 3 | 1400 |
| Y318A | V3 (tip) | 2 | 1000 |
| N392A | V4 | 7 | 23 |
| I420A | C4 | 9 | 11 |
| I423A | C4 | 40 | 14 |
| I424A | C4 | 10 | 9 |

[a]Amino acid numbering is based on the sequence of HIV-1$_{HxB2}$.
[b]Amino acid identity was determined based on a sequence alignment of HIV-1 isolates listed in the HIV sequence database at http://hiv-weblanl.gov/content/hiv-db/mainpage.html
[c]C refers to constant domains and V refers to variable loops.
[d]Neutralization activity is reported as fold increase in IC50 value relative to WT JR-CSF and was calculated using the equation (IC$_{50}$ mutant/IC$_{50}$ WT). Boxes are color coded as follows: white, substitutions which had a negative effect on neutralization activity; light grey, 4-9 fold IC$_{50}$ increase; medium grey, 10-100 fold IC$_{50}$ increase; dark grey, >100 fold IC$_{50}$ increase. Experiments were performed in triplicate and values represent an average of at least three independent experiments.

Example 18: Identification of 14443 C16 (PG16) Sister Clones

1443_C16 sister clones were identified by screening clonal transfection of rescued variable region genes for JR-CSR neutralization. Thus, antibodies that were identified as sister clones of 1443 C16 (PG16) have the similar HIV neutralization profiles as the human monoclonal 1443 C16 (PG16). Moreover, the nucleic acid or amino acid sequences of the sister clone antibodies are at least 50%, 55%, 60%, 70%, 75%, 80%, 85%, 90%, 95%, 99%, 100% or any percentage point in between, identical to those of 1443 C16 (PG16).

TABLE 22

| 1443 C16 Sister mAbs | Gamma Chain Clone | Light Chain Clone | Antibody concentration (µg/ml) | JRCSF Neutralization Index |
|---|---|---|---|---|
| 1456 A12 | 1456_A12_G3_01_002 | 1456_A12_L2_01_023 | 0.006 | 0.90 |
|  |  | 1456_A12_L2_01_036 | 0.012 | 0.82 |
|  |  | 1456_A12_L2_01_040 | 0.016 | 2.79 |
|  | 1456_A12_G3_01_004 | 1456_A12_L2_01_023 | <0.005 | 1.00 |
|  |  | 1456_A12_L2_01_036 | <0.005 | 1.02 |
|  |  | 1456_A12_L2_01_040 | 0.005 | 6.95 |
| 1469 M23 | 1469_M23_G3_01_005 | 1469_M23_L2_01_001 | 2.624 | 215.74 |
|  | 1469_M23_G3_01_006 |  | 0.000 | 10.05 |
| 1480 I08 | 1480_I08_G3_01_012 | 1480_I08_L2_01_005 | <0.005 | 10.34 |
|  | 1480_I08_G3_01_016 |  | 10 | 223.14 |
|  | 1480_I08_G3_01_021 |  | <0.005 | 2.98 |
|  | 1480_I08_G3_01_032 |  | <0.005 | 3.83 |
|  | 1480_I08_G3_01_037 |  | 34 | 1.36 |
|  | 1480_I08_G3_01_055 |  | <0.005 | 1.16 |
| 1489 I13 | 1489_I13_G3_01_003 | 1489_I13_L2_01_007 | 0.0000 | 2.02 |
|  | 1489_I13_G3_01_004 |  | 0.0009 | 22.86 |
|  | 1489_I13_G3_01_007 |  | 1.455 | 139.35 |
| 1503 H05 | 1503_H05_G1_01_001 | 1503_H05_L2_01_021 | 0.013 | 0.96 |
|  | 1503_H05_G1_01_006 |  | 0.000 | 3.75 |
|  | 1503_H05_G3_01_005 |  | 1.108 | 91.41 |
|  | 1503_H05_G3_01_007 |  | 0.567 | 155.54 |

Note that the constant region of the 1456_A12 heavy chain clones used in transfection contains an error generated during the cloning process that lead to no full-length IgG production.

Example 19: 1443_C16 (PG16) Antibody Sister Clones and the 1443_C16 (PG16) Antibody Exhibit Similar Neutralization Specificity Antibodies 1456 A12, 1503 H05, 1489 I13 and 1469 M23 were tested for neutralization activity against several pseudoviruses containing distinct mutations that map the reactivity epitope of 1443 C16 (PG16) on gp120 in a standard TZM-bl assay (Table 23). Like 1443 C16 (PG16), which does not bind or neutralize wild-type JR-FL, but instead, neutralizes JR-FL with the E168K mutation, all 1443 C16 (PG16) sister clones neutralize JR-FL(E168K) with low IC50 values. Similarly, all 1443 C16 (PG16) sister clones do not neutralize the Y318A mutants and 1309A mutants of JR-CSF, where the part of the putative binding epitope is mapped on the V3 tip.

TABLE 23

Neutralization specificity of 1443 C16 (PG16) sister clones as shown with specific mutations on gp120.

| | IC50 (ug/ml) | | | | | |
|---|---|---|---|---|---|---|
| mAb | JR-CSF | JR-CSF (Y318A) | JR-CSF (I309A) | JR-FL (E168K) | ADA | 92RW020 |
| 1503 H05 | 0.001 | >1.0 | >1.0 | 0.002 | 0.003 | 0.020 |
| 1456 A12 | 0.001 | >1.0 | >1.0 | 0.003 | 0.005 | 0.050 |
| 1469 M23 | 0.002 | >1.0 | >1.0 | 0.005 | 0.005 | 0.050 |
| 1489 I13 | 0.002 | >1.0 | >1.0 | 0.005 | 0.008 | 0.030 |
| 1443 C16 | 0.001 | >1.0 | >1.0 | 0.006 | 0.004 | 0.090 |
| 1496 C09 | 0.006 | 0.001 | 0.001 | 0.020 | 0.200 | 0.100 |

Example 20: 1443_C16 (PG16) Sister Clones Exhibit Similar Neutralization Breadth and Potency as 1443_C16 (PG16) for Clade B and Clade C Viruses The antibodies 1456 A12, 1503 H05, 1489 I13 and 1469 M23 exhibit neutralization activity against a panel of clade B and clade C pseudoviruses with similar breadth as does 1443 C16 (PG16) in a standard TZM-bl assay (Table 24). The neutralization potency of each sister clone for each pseudovirus is comparable to that for 1443 C16 (PG16). When the IC50 value is determined, the value for the sister clone is within a 0.5 log range from that for 1443 C16 (PG16).

TABLE 24

Neutralization breadth and potency of 1443 C16 (PG16) sister clones.

| | | IC50 (ug/ml) | | | | |
|---|---|---|---|---|---|---|
| | Virus | 1443 C16 | 1456 A12 | 1469 M23 | 1503 H05 | 1489 I13 |
| Clade B | CAAN | 6.37 | 10.61 | 17.72 | 13.46 | 24.87 |
| | REJ04541 | <0.01 | <0.01 | 0.39 | 0.22 | 0.34 |
| | THRO.18 | 2.19 | 2.08 | 7.01 | 4.12 | 7.41 |
| | PVO.4 | 12.3 | 10.42 | 21.25 | 11.01 | 20.57 |
| | TR0.11 | 3.61 | 3.05 | 7.52 | 4.30 | 10.94 |
| | AC10 | <0.01 | <0.01 | <0.01 | <0.01 | <0.01 |
| Clade C | DU156 | <0.01 | <0.01 | <0.01 | <0.01 | <0.01 |
| | DU422 | 0.59 | 0.36 | 0.97 | 0.71 | 1.87 |
| | Du172 | <0.01 | <0.01 | <0.01 | <0.01 | <0.01 |
| | ZM214 | >25 | >25 | >25 | >25 | >25 |
| | ZM233 | <0.01 | <0.01 | <0.01 | <0.01 | <0.01 |
| | CAP45 | <0.01 | <0.01 | <0.01 | <0.01 | <0.01 |
| | ZM249 | <0.01 | <0.01 | <0.01 | <0.01 | <0.01 |
| Control | MuLV | >25 | >25 | >25 | >25 | >25 |

Example 21: Primary and Confirmatory Screening Results for Selected Antibodies Isolated from B-Cell Cultures Established from Human Donors The screening strategy used in the isolation of the monoclonal antibodies PGT-121 (corresponding to clones 4838_L06 and 4873_E03), PGT-122 (corresponding to clone 4877_D15), PGT-123 (corresponding to clone 4858_P08), PGT-125 (corresponding to clone 5123_A06), PGT-126 (corresponding to clone 5141_B17), PGT-130 (corresponding to clone 5147_N06), PGT-135 (corresponding to clones 5343_B08 and 5344_E16), and PGT-136 (corresponding to clones 5329_C19 and 5366_P21) is the same as the PG9 and PG16 mAbs, except that functional neutralization was the only primary screening assay used (i.e. no ELISA was used to screen these antibodies).

Moreover, the strategy use to identify these mAbs following reverse transcription polymerase chain reaction (RT-PCR) rescue differs from previous protocols. Specifically, in addition to performing a primary neutralization screening step, a confirmatory screening step was performed for some of the positive hits identified from the primary screening step (Tables 25-27). The confirmatory screening step was performed using the same assay as the primary screening step. Following functional screening, the B cell culture lysates were subjected to variable gene family-specific RT-PCR, as performed previously to identify the PG9 and PG16 mAbs. However, instead of directly cloning into $IgG_1$ expression vector, the PCR products representing the rescued heavy and light chains were subjected to deep sequencing, which is also known as "next-generation sequencing", "454 sequencing" or "pyrosequencing."

In the process of deep sequencing, a B cell well location-specific sequence tag was built into the second round of PCR to enable the identification of B cell well origin of each sequence determined in the subsequent pooled sequencing reaction. One or more consensus variable gene sequences were generated from each B cell culture well by an informatics algorithm. The consensus sequences from an individual B cell well were then compared among all consensus sequences generated from other B cell culture wells. Similar heavy chains or light chain sequences were "clustered" because similar mAbs may be derived from the same precursor B cell. Selected variable genes were then cloned into an $IgG_1$ expression vector to produce and purify monoclonal antibodies. Unlike the previous rescue strategy, polyclonal transfection was not performed to screen for neutralization activity to identify potential variable genes from the PCR product pool prior to proceeding to monoclonal transfection.

The similarity among variable genes that were "clustered" is apparent in the alignment of nucleotide and amino acid sequence alignments (Tables 28-31). For instance, all three mAbs from donor 517, i.e. PGT-121, PGT-122 and PGT-123 are in the same cluster. Donor 196 provided two distantly related clusters of mAbs, with one cluster including PGT-125 and PGT-126, and another including PGT-130. Donor 039 provided two distantly related clusters of mAbs, each including PGT-135 or PGT-136.

TABLE 25

| | | Donor 517 | | | | |
|---|---|---|---|---|---|---|
| mAb ID | B Cell Culture Well ID | Primary Neutralization Index | | | | Confirmatory Neutralization Index |
| | | 92BR020 | 94UG103 | JRCSF | MGRM-C-26 | Range MGRM-C-026 |
| PGT-121 | 4838_L06 | 4.9 | 1.4 | 3.2 | 996.3 | high >50 |
| | 4873_E03 | 3.6 | 0.8 | 2.2 | 371.4 | high >50 |
| N/A | 4869_K15 | 3.9 | 1.5 | 2.1 | 103.9 | high >50 |
| PGT-122 | 4877_D15 | 5.4 | 1.3 | 2.3 | 37.5 | moderate 10-50 |
| PGT-123 | 4858_P8 | 2.8 | 1.1 | 1.6 | 33.8 | moderate 10-50 |
| N/A | 4834_C11 | 2.5 | 1.1 | 2.0 | 28.3 | moderate 10-50 |

TABLE 26

Donor 196

| mAb ID | B Cell Culture Well ID | Primary Neutralization Index | | | Confirmatory Neutralization | | Polyclonal Transfectant Neutralization Index | | |
|---|---|---|---|---|---|---|---|---|---|
| | | 92TH021 | JRCSF | MGRM-C-26 | Virus | Index Range | 92TH021 | JRCSF | MGRM-C-026 |
| PGT-125 | 5123_A6 | 133.0 | 1727.6 | 511.5 | JRCSF | high >50 | 50.65 | 118.60 | 88.31 |
| PGT-126 | 5141_B17 | 2.3 | 1410.1 | 653.9 | JRCSF | high >50 | 2.74 | 101.51 | 102.41 |
| PGT-127 | 5145_B14 | 1.0 | 31.1 | 86.9 | MGRM-C-026 | high >50 | 0.94 | 1.61 | 2.62 |
| PGT-128 | 5114_A19 | 6.6 | 77.5 | 17.1 | JRCSF | high >50 | 10.02 | 136.49 | 32.19 |
| PGT-130 | 5147_N6 | 538.2 | 19.3 | 3.0 | 92TH021 | high >50 | 4.20 | 1.24 | 1.05 |
| PGT-131 | 5136_H1 | 354.0 | 6.2 | 1.2 | 92TH021 | high >50 | | | |
| PGT-132 | 5113_D22 | 51.0 | 3.0 | 6.0 | 92TH021 | high >50 | | | |
| PGT-133 | 5117_E22 | 42.5 | 3.6 | 3.4 | 92TH021 | high >50 | | | |

TABLE 27

Donor 039

| mAb ID | B Cell Culture Well ID | Primary Neutralization Index | | | Confirmatory Neutralization Index | |
|---|---|---|---|---|---|---|
| | | 93IN905 | JRCSF | MGRM-C-26 | Virus | Index Range |
| PGT-135 | 5343_B8 | 43.0 | 1.8 | 6.5 | 93IN905 | moderate 10-50 |
| PGT-137 | 5345_I1 | 3.3 | 1.1 | 11.3 | MGRM-C-026 | moderate 10-50 |
| PGT-136 | 5366_P21 | 5.5 | 1.1 | 6.2 | MGRM-C-026 | mod low 5-10 |
| | 5329_C19 | 5.6 | 0.9 | 6.0 | MGRM-C-026 | mod low 5-10 |
| PGT-135 | 5344_E16 | 2.3 | 1.5 | 3.6 | MGRM-C-026 | low 1.5-5 |

Example 22: Neutralization Values ($IC_{50}$, $IC_{80}$, $IC_{90}$, and IC95) Against 23 HIV Viruses for Selected Antibodies Isolated from B-Cell Cultures Established from Human Donors Table 32 shows neutralization profiles ($IC_{50}$ values) of monoclonal antibodies PGT 121, PGT 122, PGT 123, PGT 125, PGT 126, PGT 130, PGT 135, PGT 136, and PG9 on a diverse panel of 23 HIV viruses from different clades (A, B, C, D, AE, and AG). PGT 121, PGT 122, PGT 123, PGT 125, PGT 126, PGT 130, PGT 135, and PGT 136 all neutralize virus in clades A, B, C, and D. Moreover, PGT 121, PGT 122, and PGT 123 also neutralize virus in clade AG. PGT 125 neutralizes clades A, B, C, D, AE, whereas PGT 126 and PGT 130 neutralize all clades, i.e. A, B, C, D, AE, and AG.

Table 33 shows $IC_{50}$, $IC_{80}$, $IC_{90}$, and $IC_{95}$ values of the PGT 121 monoclonal antibody on the same panel of viruses shown in Table 32. The results shown on this table recapitulate those shown on Table 32 for the PGT 121 monoclonal antibody. This table further demonstrates that the PGT 121 monoclonal antibody neutralizes HIV virus from clades A, B, C, and D strongly, as evidenced by low $IC_{95}$ values shown for these clades.

Table 34 shows $IC_{50}$, $IC_{80}$, $IC_{90}$, and $IC_{95}$ values of the PGT 122 monoclonal antibody on the same panel of viruses shown in Table 32. The results shown on this table recapitulate those shown on Table 32 for the PGT 122 monoclonal antibody. This table further demonstrates that the PGT 122 monoclonal antibody neutralizes HIV virus from clades A, B, C, and D strongly, as evidenced by low $IC_{95}$ values shown for these clades.

Table 35 shows $IC_{50}$, $IC_{80}$, $IC_{90}$, and IC95 values of the PGT 123 monoclonal antibody on the same panel of viruses shown in Table 32. The results shown on this table recapitulate those shown on Table 32 for the PGT 123 monoclonal antibody. This table further demonstrates that the PGT 123 monoclonal antibody neutralizes HIV virus from clades A, B, C, and D strongly, as evidenced by low $IC_{95}$ values shown for these clades.

Table 36 shows $IC_{50}$, $IC_{80}$, $IC_{90}$, and $IC_{95}$ values of the PGT 125 monoclonal antibody on the same panel of viruses shown in Table 32. The results shown on this table recapitulate those shown on Table 32 for the PGT 125 monoclonal antibody. This table further demonstrates that the PGT 125 monoclonal antibody neutralizes HIV virus from clades A, B, C, D, and AE strongly, as evidenced by low $IC_{95}$ values shown for these clades.

Table 37 shows $IC_{50}$, $IC_{80}$, $IC_{90}$, and $IC_{95}$ values of the PGT 126 monoclonal antibody on the same panel of viruses shown in Table 32. The results shown on this table recapitulate those shown on Table 32 for the PGT 126 monoclonal antibody. This table further demonstrates that the PGT 126 monoclonal antibody neutralizes HIV virus from clades A, B, C, and D strongly, as evidenced by low $IC_{95}$ values shown for these clades.

Table 38 shows $IC_{50}$, $IC_{80}$, $IC_{90}$, and $IC_{95}$ values of the PGT 130 monoclonal antibody on the same panel of viruses shown in Table 32. The results shown on this table recapitulate those shown on Table 32 for the PGT 130 monoclonal antibody. This table further demonstrates that the PGT 130 monoclonal antibody neutralizes HIV virus from clades A, B, C, and AE strongly, as evidenced by low $IC_{95}$ values shown for these clades.

Table 39 shows $IC_{50}$, $IC_{80}$, $IC_{90}$, and $IC_{95}$ values of the PGT 135 monoclonal antibody on the same panel of viruses shown in Table 32. The results shown on this table recapitulate those shown on Table 32 for the PGT 135 monoclonal antibody. This table further demonstrates that the PGT 135 monoclonal antibody neutralizes HIV virus from clades B, C, and D strongly, as evidenced by low $IC_{95}$ values shown for these clades.

Table 40 shows $IC_{50}$, $IC_{80}$, $IC_{90}$, and $IC_{95}$ values of the PGT 136 monoclonal antibody on the same panel of viruses shown in Table 32. The results shown on this table recapitulate those shown on Table 32 for the PGT 136 monoclonal antibody. This table further demonstrates that the PGT 136 monoclonal antibody neutralizes HIV virus from clades C and D strongly, as evidenced by low $IC_{95}$ values shown for these clades.

Table 41 shows $IC_{50}$, $IC_{80}$, $IC_{90}$, and $IC_{95}$ values of the PG9 monoclonal antibody on the same panel of viruses shown in Table 32. The results shown on this table recapitulate those shown on Table 32 for the PG9 monoclonal antibody. This table further demonstrates that the PG9 monoclonal antibody neutralizes HIV virus from clades A, B, C, D, and AE strongly, as evidenced by low IC95 values shown for these clades.

For Tables 32-41, the following scheme applies regarding the concentration of the appropriate antibody:

| |
|---|
| 10 ng/ml |
| 100 ng/ml |
| 1000 ng/ml |
| 1000-10,000 ng/ml |
| Negative = >10 |

TABLE 32

$IC_{50}$ Neutralization Values for PGT-121, PGT-122, PGT-123, PGT-125, PGT-126, PGT-130, PGT-135, and PGT-136.

| | | $IC_{50}$ (ug/mL) | | | | | | | | | IC50 (Reciprocal of dilution) | | |
|---|---|---|---|---|---|---|---|---|---|---|---|---|---|
| | | Donor 517 | | | Donor 196 | | | Donor 039 | | Donor 064 | Reference Serum | | |
| Clade | Virus | PGT-121 | PGT-122 | PGT-123 | PGT-125 | PGT-126 | PGT-130 | PGT-135 | PGT-136 | PG9 | Z23-6X | Z23 | Z23 |
| A | 92RW020 | 0.0063 | 0.0072 | 0.0038 | 0.0028 | 0.0046 | 0.0140 | 0.1573 | 0.7383 | 0.1614 | 219 | 327 | 322 |
| | 93UG077 | 0.0459 | 0.1913 | 0.0303 | 0.0262 | 0.0256 | >10* | >10 | >10 | >10 | 336 | 392 | 365 |
| | 94UG103 | 1.3778 | 1.4643 | 0.8461 | 0.0124 | 0.0091 | 0.6355 | >10 | >10 | 0.3098 | 179 | 238 | 235 |
| | MGRM-A-010 | 2.6078 | 1.6836 | 0.4921 | 0.0055 | 0.0033 | 0.0054 | >10 | >10 | 0.0375 | 236 | 258 | 308 |
| B | 92BR020 | 0.0177 | 0.0337 | 0.0130 | 0.0214 | 0.0163 | 1.1242 | 0.1043 | >10 | >10 | 308 | 364 | 336 |
| | APV13 | 0.3157 | 0.9923 | 0.2215 | 0.0128 | 0.0120 | 0.0345 | 0.5452 | >10 | >10 | 217 | 297 | 232 |
| | APV17 | 0.0950 | 0.5220 | 0.1798 | 7.3065 | 0.5013 | >10 | >10 | >10 | >10 | 297 | 283 | 273 |
| | APV6 | 0.0423 | 0.0851 | 0.0328 | 0.0359 | 0.0249 | >10 | >10 | >10 | 0.2139 | 396 | 458 | 682 |
| | JRFL | 0.0276 | 0.0471 | 0.0283 | 0.0156 | 0.0140 | 0.0346 | >10 | >10 | >10 | 533 | 608 | 612 |
| | JRCSF | 0.0343 | 0.0727 | 0.0423 | 0.0060 | 0.0061 | 0.0089 | 0.1131 | >10 | 0.0048 | 425 | 401 | 472 |
| | NL43 | >10 | >10 | >10 | >10 | >10 | >10 | 6.7910 | >10 | 0.6871 | 3905 | 3823 | 3577 |
| C | 93IN905 | 0.0082 | 0.0138 | 0.0071 | 0.0137 | 0.0194 | 0.0182 | 0.0183 | 0.0135 | 0.0480 | 366 | 405 | 395 |
| | MGRM-C-026 | 0.0034 | 0.0089 | 0.0031 | 0.0106 | 0.0076 | 0.0173 | 0.0123 | 0.0065 | 0.1130 | 426 | 299 | 298 |
| | MGRM-C-027 | 0.0094 | 0.0388 | 0.0169 | >10 | 1.1404 | 0.0052 | >10 | >10 | 2.4538 | 355 | 340 | 472 |
| | MGRM-C-028 | 1.1929 | 2.0600 | 0.4433 | 5.7772 | 0.2827 | >10 | 2.1608 | >10 | 0.1211 | 168 | 145 | 195 |
| D | 92UG005 | >10 | >10 | 2.4924 | >10 | 0.0181 | 0.4741 | >10 | >10 | >10 | 350 | 361 | 379 |
| | 92UG024 | >10 | >10 | >10 | >10 | >10 | >10 | 0.0139 | 0.0915 | 1.9142 | 343 | 338 | 433 |
| | MGRM-D-001 | 0.7442 | 0.8673 | 0.2154 | 2.3116 | 0.0639 | >10 | >10 | >10 | >10 | <100 | 114 | 150 |
| | MGRM-D-018 | 0.0086 | 0.0115 | 0.0047 | 0.0382 | 0.0093 | 0.0378 | 0.0433 | >10 | 0.0444 | 414 | 367 | 329 |
| AE | 92TH021 | >10 | >10 | >10 | 0.0066 | 0.1147 | 0.0082 | >10 | >10 | 0.1026 | 287 | 290 | 304 |
| | CMU02 | >10 | >10 | >10 | >10 | >10 | >10 | >10 | >10 | >10 | 309 | 308 | 277 |
| AG | MGRM-AG-005 | 1.1719 | >10 | 0.1036 | >10 | 1.3488 | 0.9466 | >10 | >10 | >10 | 134 | 197 | 209 |
| | aMLV | >10 | >10 | >10 | >10 | >10 | >10 | >10 | >10 | >10 | <100 | <100 | <100 |

TABLE 33

Neutralization Values for PGT-121.
Neutralization by PGT-121 (ug/ml)

| Clade | Virus | IC50 | IC80 | IC90 | IC95 | Overall |
|---|---|---|---|---|---|---|
| A | 92RW020 | 0.0063 | 0.0188 | 0.0361 | 0.0671 | P |
|  | 93UG077 | 0.0459 | 0.1716 | 0.3691 | 0.7402 | P |
|  | 94UG103 | 1.3778 | 8.8543 | >10.0000 | >10.0000 | P |
|  | MGRM-A-010 | 2.6078 | >10.0000 | >10.0000 | >10.0000 | P |
| B | 92BR020 | 0.0177 | 0.0532 | 0.1011 | 0.1828 | P |
|  | APV13 | 0.3157 | 1.3067 | 2.7989 | 5.1522 | P |
|  | APV17 | 0.0950 | 0.3707 | 0.7991 | 1.5541 | P |
|  | APV6 | 0.0423 | 0.1447 | 0.2960 | 0.5688 | P |
|  | JRFL | 0.0276 | 0.0806 | 0.1506 | 0.2674 | P |
|  | JRCSF | 0.0343 | 0.1119 | 0.2226 | 0.4169 | P |
|  | NL43 | >10.0000 | >10.0000 | >10.0000 | >10.0000 | N |
| C | 93IN905 | 0.0082 | 0.0302 | 0.0645 | 0.1298 | P |
|  | MGRM-C-026 | 0.0034 | 0.0140 | 0.0320 | 0.0687 | P |
|  | MGRM-C-027 | 0.0094 | 0.0829 | 0.3739 | 3.1434 | P |
|  | MGRM-C-028 | 1.1929 | 4.9098 | >10.0000 | >10.0000 | P |
| D | 92UG005 | >10.0000 | >10.0000 | >10.0000 | >10.0000 | N |
|  | 92UG024 | >10.0000 | >10.0000 | >10.0000 | >10.0000 | N |
|  | MGRM-D-001 | 0.7442 | 3.2881 | 6.2560 | 9.3894 | P |
|  | MGRM-D-018 | 0.0086 | 0.0231 | 0.0414 | 0.0715 | P |
| AE | 92TH021 | >10.0000 | >10.0000 | >10.0000 | >10.0000 | N |
|  | CMU02 | >10.0000 | >10.0000 | >10.0000 | >10.0000 | N |
| AG | MGRM-AG-005 | 1.1719 | >10.0000 | >10.0000 | >10.0000 | P |
|  | aMLV | >10.0000 | >10.0000 | >10.0000 | >10.0000 | N |

TABLE 34

Neutralization Values for PGT-122.
Neutralization by PGT-122 (ug/ml)

| Clade | Virus | IC50 | IC80 | IC90 | IC95 | Overall |
|---|---|---|---|---|---|---|
| A | 92RW020 | 0.0072 | 0.0407 | 0.1127 | 0.2891 | P |
|  | 93UG077 | 0.1913 | 0.9312 | 2.0994 | 3.8823 | P |
|  | 94UG103 | 1.4643 | 6.5793 | >10.0000 | >10.0000 | P |
|  | MGRM-A-010 | 1.6836 | >10.0000 | >10.0000 | >10.0000 | P |
| B | 92BR020 | 0.0337 | 0.0929 | 0.1680 | 0.2895 | P |
|  | APV13 | 0.9923 | 4.1434 | 8.6010 | >10.0000 | P |
|  | APV17 | 0.5220 | 1.7580 | 3.5831 | 6.9228 | P |
|  | APV6 | 0.0851 | 0.3508 | 0.7787 | 1.5492 | P |
|  | JRFL | 0.0471 | 0.1655 | 0.3422 | 0.6590 | P |
|  | JRCSF | 0.0727 | 0.2455 | 0.4945 | 0.9261 | P |
|  | NL43 | >10.0000 | >10.0000 | >10.0000 | >10.0000 | N |
| C | 93IN905 | 0.0138 | 0.0505 | 0.1080 | 0.2172 | P |
|  | MGRM-C-026 | 0.0089 | 0.0370 | 0.0849 | 0.1811 | P |
|  | MGRM-C-027 | 0.0388 | 0.4995 | >10.0000 | >10.0000 | P |
|  | MGRM-C-028 | 2.0600 | >10.0000 | >10.0000 | >10.0000 | P |
| D | 92UG005 | >10.0000 | >10.0000 | >10.0000 | >10.0000 | N |
|  | 92UG024 | >10.0000 | >10.0000 | >10.0000 | >10.0000 | N |
|  | MGRM-D-001 | 0.8673 | 4.4756 | >10.0000 | >10.0000 | P |
|  | MGRM-D-018 | 0.0115 | 0.0350 | 0.0674 | 0.1247 | P |
| AE | 92TH021 | >10.0000 | >10.0000 | >10.0000 | >10.0000 | N |
|  | CMU02 | >10.0000 | >10.0000 | >10.0000 | >10.0000 | N |
| AG | MGRM-AG-005 | >10.0000 | >10.0000 | >10.0000 | >10.0000 | N |
|  | aMLV | >10.0000 | >10.0000 | >10.0000 | >10.0000 | N |

TABLE 35

Neutralization Values for PGT-123.
Neutralization by PGT-123 (ug/mll)

| Clade | Virus | IC50 | IC80 | IC90 | IC95 | Overall |
|---|---|---|---|---|---|---|
| A | 92RW020 | 0.0038 | 0.0106 | 0.0194 | 0.0343 | P |
|   | 93UG077 | 0.0303 | 0.1433 | 0.3504 | 0.7798 | P |
|   | 94UG103 | 0.8461 | 3.2922 | 8.5552 | >10.0000 | P |
|   | MGRM-A-010 | 0.4921 | 2.7917 | 6.4406 | >10.0000 | P |
| B | 92BR020 | 0.0130 | 0.0390 | 0.0741 | 0.1339 | P |
|   | APV13 | 0.2215 | 0.8787 | 1.8718 | 3.5039 | P |
|   | APV17 | 0.1798 | 0.5389 | 1.0082 | 1.7530 | P |
|   | APV6 | 0.0328 | 0.1447 | 0.3394 | 0.7264 | P |
|   | JRFL | 0.0283 | 0.0904 | 0.1782 | 0.3318 | P |
|   | JRCSF | 0.0423 | 0.1428 | 0.2890 | 0.5467 | P |
|   | NL43 | >10.0000 | >10.0000 | >10.0000 | >10.0000 | N |
| C | 93IN905 | 0.0071 | 0.0281 | 0.0625 | 0.1306 | P |
|   | MGRM-C-026 | 0.0031 | 0.0094 | 0.0183 | 0.0338 | P |
|   | MGRM-C-027 | 0.0169 | 0.1495 | >10.0000 | >10.0000 | P |
|   | MGRM-C-028 | 0.4433 | 2.8001 | 7.1057 | >10.0000 | P |
| D | 92UG005 | 2.4924 | >10.0000 | >10.0000 | >10.0000 | P |
|   | 92UG024 | >10.0000 | >10.0000 | >10.0000 | >10.0000 | N |
|   | MGRM-D-001 | 0.2154 | 0.6779 | 1.3056 | 2.3279 | P |
|   | MGRM-D-018 | 0.0047 | 0.0175 | 0.0381 | 0.0791 | P |
| AE | 92TH021 | >10.0000 | >10.0000 | >10.0000 | >10.0000 | N |
|   | CMU02 | >10.0000 | >10.0000 | >10.0000 | >10.0000 | N |
| AG | MGRM-AG-005 | 0.1036 | 1.2780 | 6.3844 | >10.0000 | P |
|   | aMLV | >10.0000 | >10.0000 | >10.0000 | >10.0000 | N |

TABLE 36

Neutralization Values for PGT-125.
Neutralization by PGT-125 (ug/ml)

| Clade | Virus | IC50 | IC80 | IC90 | IC95 | Overall |
|---|---|---|---|---|---|---|
| A | 92RW020 | 0.0028 | 0.0110 | 0.0248 | 0.0526 | P |
|   | 93UG077 | 0.0262 | 0.0926 | 0.2057 | 0.4866 | P |
|   | 94UG103 | 0.0124 | 0.0373 | 0.0710 | 0.1287 | P |
|   | MGRM-A-010 | 0.0055 | 0.0240 | 0.0575 | 0.1313 | P |
| B | 92BR020 | 0.0214 | 0.0738 | 0.1557 | 0.3228 | P |
|   | APV13 | 0.0128 | 0.0414 | 0.0821 | 0.1543 | P |
|   | APV17 | 7.3065 | >10.0000 | >10.0000 | >10.0000 | P |
|   | APV6 | 0.0359 | 0.1330 | 0.2885 | 0.5974 | P |
|   | JRFL | 0.0156 | 0.0462 | 0.0873 | 0.1571 | P |
|   | JRCSF | 0.0060 | 0.0196 | 0.0392 | 0.0741 | P |
|   | NL43 | >10.0000 | >10.0000 | >10.0000 | >10.0000 | N |
| C | 93IN905 | 0.0137 | 0.0494 | 0.1056 | 0.2165 | P |
|   | MGRM-C-026 | 0.0106 | 0.0350 | 0.0705 | 0.1342 | P |
|   | MGRM-C-027 | >10.0000 | >10.0000 | >10.0000 | >10.0000 | N |
|   | MGRM-C-028 | 5.7772 | >10.0000 | >10.0000 | >10.0000 | P |
| D | 92UG005 | >10.0000 | >10.0000 | >10.0000 | >10.0000 | N |
|   | 92UG024 | >10.0000 | >10.0000 | >10.0000 | >10.0000 | N |
|   | MGRM-D-001 | 2.3116 | >10.0000 | >10.0000 | >10.0000 | P |
|   | MGRM-D-018 | 0.0382 | 0.1440 | 0.3389 | 0.8924 | P |
| AE | 92TH021 | 0.0066 | 0.0292 | 0.0701 | 0.1572 | P |
|   | CMU02 | >10.0000 | >10.0000 | >10.0000 | >10.0000 | N |
| AG | MGRM-AG-005 | >10.0000 | >10.0000 | >10.0000 | >10.0000 | N |
|   | aMLV | >10.0000 | >10.0000 | >10.0000 | >10.0000 | N |

TABLE 37

Neutralization Values for PGT-126.
Neutralization by PGT-126 (ug/ml)

| Clade | Virus | IC50 | IC80 | IC90 | IC95 | Overall |
|---|---|---|---|---|---|---|
| A | 92RW020 | 0.0046 | 0.0168 | 0.0359 | 0.0728 | P |
|   | 93UG077 | 0.0256 | 0.1015 | 0.2385 | 0.5771 | P |
|   | 94UG103 | 0.0091 | 0.0316 | 0.0655 | 0.1280 | P |
|   | MGRM-A-010 | 0.0033 | 0.0137 | 0.0316 | 0.0687 | P |
| B | 92BR020 | 0.0163 | 0.0457 | 0.0846 | 0.1521 | P |
|   | APV13 | 0.0120 | 0.0411 | 0.0840 | 0.1621 | P |
|   | APV17 | 0.5013 | 4.4290 | >10.0000 | >10.0000 | P |
|   | APV6 | 0.0249 | 0.0681 | 0.1230 | 0.2134 | P |
|   | JRFL | 0.0140 | 0.0454 | 0.0900 | 0.1688 | P |
|   | JRCSF | 0.0061 | 0.0180 | 0.0339 | 0.0608 | P |
|   | NL43 | >10.0000 | >10.0000 | >10.0000 | >10.0000 | N |
| C | 93IN905 | 0.0194 | 0.0676 | 0.1404 | 0.2751 | P |
|   | MGRM-C-026 | 0.0076 | 0.0345 | 0.0831 | 0.1849 | P |
|   | MGRM-C-027 | 1.1404 | >10.0000 | >10.0000 | >10.0000 | P |
|   | MGRM-C-028 | 0.2827 | 2.6247 | >10.0000 | >10.0000 | P |

TABLE 37-continued

Neutralization Values for PGT-126.
Neutralization by PGT-126 (ug/ml)

| Clade | Virus | IC50 | IC80 | IC90 | IC95 | Overall |
|---|---|---|---|---|---|---|
| D | 92UG005 | 0.0181 | 0.1455 | 0.5529 | 2.4508 | P |
|  | 92UG024 | >10.0000 | >10.0000 | >10.0000 | >10.0000 | N |
|  | MGRM-D-001 | 0.0639 | 0.3334 | 0.8321 | 1.7951 | P |
|  | MGRM-D-018 | 0.0093 | 0.0391 | 0.0918 | 0.2053 | P |
| AE | 92TH021 | 0.1147 | 1.6162 | 6.9070 | >10.0000 | P |
|  | CMU02 | >10.0000 | >10.0000 | >10.0000 | >10.0000 | N |
| AG | MGRM-AG-005 | 1.3488 | >10.0000 | >10.0000 | >10.0000 | P |
|  | aMLV | >10.0000 | >10.0000 | >10.0000 | >10.0000 | N |

TABLE 38

Neutralization Values for PGT-130.
Neutralization by PGT-130 (ug/ml)

| Clade | Virus | IC50 | IC80 | IC90 | IC95 | Overall |
|---|---|---|---|---|---|---|
| A | 92RW020 | 0.0140 | 0.5079 | 3.6823 | >10.0000 | P |
|  | 93UG077 | >10.0000 | >10.0000 | >10.0000 | >10.0000 | N |
|  | 94UG103 | 0.6355 | >10.0000 | >10.0000 | >10.0000 | P |
|  | MGRM-A-010 | 0.0054 | 0.0251 | 0.0643 | 0.1642 | P |
| B | 92BR020 | 1.1242 | >10.0000 | >10.0000 | >10.0000 | P |
|  | APV13 | 0.0345 | 0.5731 | 2.8823 | >10.0000 | P |
|  | APV17 | >10.0000 | >10.0000 | >10.0000 | >10.0000 | N |
|  | APV6 | >10.0000 | >10.0000 | >10.0000 | >10.0000 | N |
|  | JRFL | 0.0346 | 0.7510 | 5.7157 | >10.0000 | P |
|  | JRCSF | 0.0089 | 0.0317 | 0.0669 | 0.1341 | P |
|  | NL43 | >10.0000 | >10.0000 | >10.0000 | >10.0000 | N |
| C | 93IN905 | 0.0182 | 0.2716 | 1.3069 | 5.4770 | P |
|  | MGRM-C-026 | 0.0173 | 0.2629 | 1.3244 | 6.1260 | P |
|  | MGRM-C-027 | 0.0052 | 0.0318 | 0.1061 | 0.4638 | P |
|  | MGRM-C-028 | >10.0000 | >10.0000 | >10.0000 | >10.0000 | N |
| D | 92UG005 | 0.4741 | >10.0000 | >10.0000 | >10.0000 | P |
|  | 92UG024 | >10.0000 | >10.0000 | >10.0000 | >10.0000 | N |
|  | MGRM-D-001 | >10.0000 | >10.0000 | >10.0000 | >10.0000 | N |
|  | MGRM-D-018 | 0.0378 | 0.2892 | 2.3096 | >10.0000 | P |
| AE | 92TH021 | 0.0082 | 0.0261 | 0.0513 | 0.0963 | P |
|  | CMU02 | >10.0000 | >10.0000 | >10.0000 | >10.0000 | N |
| AG | MGRM-AG-005 | 0.9466 | >10.0000 | >10.0000 | >10.0000 | P |
|  | aMLV | >10.0000 | >10.0000 | >10.0000 | >10.0000 | N |

TABLE 39

Neutralization Values for PGT-135.
Neutralization by PGT-135 (ug/ml)

| Clade | Virus | IC50 | IC80 | IC90 | IC95 | Overall |
|---|---|---|---|---|---|---|
| A | 92RW020 | 0.1573 | 3.4582 | >10.0000 | >10.0000 | P |
|  | 93UG077 | >10.0000 | >10.0000 | >10.0000 | >10.0000 | N |
|  | 94UG103 | >10.0000 | >10.0000 | >10.0000 | >10.0000 | N |
|  | MGRM-A-010 | >10.0000 | >10.0000 | >10.0000 | >10.0000 | N |
| B | 92BR020 | 0.1043 | 0.2526 | 0.4298 | 0.7203 | P |
|  | APV13 | 0.5452 | >10.0000 | >10.0000 | >10.0000 | P |
|  | APV17 | >10.0000 | >10.0000 | >10.0000 | >10.0000 | N |
|  | APV6 | >10.0000 | >10.0000 | >10.0000 | >10.0000 | N |
|  | JRFL | >10.0000 | >10.0000 | >10.0000 | >10.0000 | N |
|  | JRCSF | 0.1131 | 0.5033 | 1.4664 | 8.2996 | P |
|  | NL43 | 6.7910 | >10.0000 | >10.0000 | >10.0000 | P |
| C | 93IN905 | 0.0183 | 0.0648 | 0.1356 | 0.2677 | P |
|  | MGRM-C-026 | 0.0123 | 0.0562 | 0.1390 | 0.3312 | P |
|  | MGRM-C-027 | >10.0000 | >10.0000 | >10.0000 | >10.0000 | N |
|  | MGRM-C-028 | 2.1608 | >10.0000 | >10.0000 | >10.0000 | P |
| D | 92UG005 | >10.0000 | >10.0000 | >10.0000 | >10.0000 | N |
|  | 92UG024 | 0.0139 | 0.0540 | 0.1220 | 0.2673 | P |
|  | MGRM-D-001 | >10.0000 | >10.0000 | >10.0000 | >10.0000 | N |
|  | MGRM-D-018 | 0.0433 | 0.1999 | >10.0000 | >10.0000 | P |
| AE | 92TH021 | >10.0000 | >10.0000 | >10.0000 | >10.0000 | N |
|  | CMU02 | >10.0000 | >10.0000 | >10.0000 | >10.0000 | N |
| AG | MGRM-AG-005 | >10.0000 | >10.0000 | >10.0000 | >10.0000 | N |
|  | aMLV | >10.0000 | >10.0000 | >10.0000 | >10.0000 | N |

TABLE 40

Neutralization Values for PGT-136.
Neutralization by PGT-136 (ug/ml)

| Clade | Virus | IC50 | IC80 | IC90 | IC95 | Overall |
|---|---|---|---|---|---|---|
| A | 92RW020 | 0.7383 | >10.0000 | >10.0000 | >10.0000 | P |
|   | 93UG077 | >10.0000 | >10.0000 | >10.0000 | >10.0000 | N |
|   | 94UG103 | >10.0000 | >10.0000 | >10.0000 | >10.0000 | N |
|   | MGRM-A-010 | >10.0000 | >10.0000 | >10.0000 | >10.0000 | N |
| B | 92BR020 | >10.0000 | >10.0000 | >10.0000 | >10.0000 | N |
|   | APV13 | >10.0000 | >10.0000 | >10.0000 | >10.0000 | N |
|   | APV17 | >10.0000 | >10.0000 | >10.0000 | >10.0000 | N |
|   | APV6 | >10.0000 | >10.0000 | >10.0000 | >10.0000 | N |
|   | JRFL | >10.0000 | >10.0000 | >10.0000 | >10.0000 | N |
|   | JRCSF | >10.0000 | >10.0000 | >10.0000 | >10.0000 | N |
|   | NL43 | >10.0000 | >10.0000 | >10.0000 | >10.0000 | N |
| C | 93IN905 | 0.0135 | 0.0623 | 0.1562 | 0.3791 | P |
|   | MGRM-C-026 | 0.0065 | 0.0285 | 0.0687 | 0.1590 | P |
|   | MGRM-C-027 | >10.0000 | >10.0000 | >10.0000 | >10.0000 | N |
|   | MGRM-C-028 | >10.0000 | >10.0000 | >10.0000 | >10.0000 | N |
| D | 92UG005 | >10.0000 | >10.0000 | >10.0000 | >10.0000 | N |
|   | 92UG024 | 0.0915 | 0.6193 | 1.9558 | 5.9700 | P |
|   | MGRM-D-001 | >10.0000 | >10.0000 | >10.0000 | >10.0000 | N |
|   | MGRM-D-018 | >10.0000 | >10.0000 | >10.0000 | >10.0000 | N |
| AE | 92TH021 | >10.0000 | >10.0000 | >10.0000 | >10.0000 | N |
|   | CMU02 | >10.0000 | >10.0000 | >10.0000 | >10.0000 | N |
| AG | MGRM-AG-005 | >10.0000 | >10.0000 | >10.0000 | >10.0000 | N |
|   | aMLV | >10.0000 | >10.0000 | >10.0000 | >10.0000 | N |

TABLE 41

Neutralization Values for PG9.
Neutralization by PG9 (ug/ml)

| Clade | Virus | IC50 | IC80 | IC90 | IC95 | Overall |
|---|---|---|---|---|---|---|
| A | 92RW020 | 0.1614 | 1.0383 | 3.4024 | >10.0000 | P |
|   | 93UG077 | >10.0000 | >10.0000 | >10.0000 | >10.0000 | N |
|   | 94UG103 | 0.3098 | 1.9524 | 5.5354 | >10.0000 | P |
|   | MGRM-A-010 | 0.0375 | 0.1215 | 0.2418 | 0.4561 | P |
| B | 92BR020 | >10.0000 | >10.0000 | >10.0000 | >10.0000 | N |
|   | APV13 | >10.0000 | >10.0000 | >10.0000 | >10.0000 | N |
|   | APV17 | >10.0000 | >10.0000 | >10.0000 | >10.0000 | N |
|   | APV6 | 0.2139 | 1.1316 | 3.2130 | 9.6532 | P |
|   | JRFL | >10.0000 | >10.0000 | >10.0000 | >10.0000 | N |
|   | JRCSF | 0.0048 | 0.0181 | 0.0391 | 0.0798 | P |
|   | NL43 | 0.6871 | >10.0000 | >10.0000 | >10.0000 | P |
| C | 93IN905 | 0.0480 | 0.3077 | 0.9807 | 3.3063 | P |
|   | MGRM-C-026 | 0.1130 | >10.0000 | >10.0000 | >10.0000 | P |
|   | MGRM-C-027 | 2.4538 | >10.0000 | >10.0000 | >10.0000 | P |
|   | MGRM-C-028 | 0.1211 | 0.6455 | 1.6522 | 3.7075 | P |
| D | 92UG005 | >10.0000 | >10.0000 | >10.0000 | >10.0000 | N |
|   | 92UG024 | 1.9142 | >10.0000 | >10.0000 | >10.0000 | P |
|   | MGRM-D-001 | >10.0000 | >10.0000 | >10.0000 | >10.0000 | N |
|   | MGRM-D-018 | 0.0444 | 0.1805 | 0.4300 | 1.0466 | P |
| AE | 92TH021 | 0.1026 | 0.4475 | 1.0694 | 2.4256 | P |
|   | CMU02 | >10.0000 | >10.0000 | >10.0000 | >10.0000 | N |
| AG | MGRM-AG-005 | >10.0000 | >10.0000 | >10.0000 | >10.0000 | N |
|   | aMLV | >10.0000 | >10.0000 | >10.0000 | >10.0000 | N |

Example 23: Heavy and Light Chain Usage for Selected Antibodies Isolated from B-Cell Cultures Established from Human Donors Monoclonal antibodies PGT-121 (corresponding to clones 4838_L06 and 4873_E03), PGT-122 (corresponding to clone 4877_D15), PGT-123 (corresponding to clone 4858_P08), PGT-125 (corresponding to clone 5123_A06), PGT-126 (corresponding to clone 5141_B17), PGT-130 (corresponding to clone 5147_N06), PGT-135 (corresponding to clones 5343_B08 and 5344_E16), and PGT-136 (corresponding to clones 5329_C19 and 5366_P21) are derived from related germline genes.

The similarity of the variable genes is apparent based on the gene usage (Tables 42 and 43). Although the exact gene alleles used may not be definitive, the alleles that are most likely used are provided with the percentage identity to the germline gene noted.

TABLE 42

Heavy Chain Germline Gene Usage for PGT-121, PGT-122, PGT-123, PGT-125, PGT-126, PGT-130, PGT-135, and PGT-136.

| mAb Clone | Germline V-gene allele | Identity to V-gene | Germline J-gene allele | Identity to J-gene | Heavy chain CDR3 |
|---|---|---|---|---|---|
| PGT-121 | IGHV4-59*01 or IGHV4-59*07 | 80.35% (229/285 nt) | IGHJ6*03 | 82.26% (51/62 nt) | TLHGRRIYGIVAFNEWFTYFYMDV (SEQ ID NO: 143) |
|  | IGHV4-59*02 or IGHV4-59*03 or IGHV4-61*08 | 80.00% (228/285 nt) |  |  |  |
| PGT-122 | IGHV4-61*08 | 80.35% (229/285 nt) | IGHJ6*03 | 83.87% (52/62 nt) | TKHGRRIYGVVAFKEWFTYFYMDV (SEQ ID NO: 262) |
|  | IGHV4-59*02 | 80.00% (228/285 nt) |  |  |  |
|  | IGHV4-59*01 | 79.65% (227/285 nt) |  |  |  |
| PGT-123 | IGHV4-59*03 | 77.54% (221/285 nt) | IGHJ6*03 | 83.87% (52/62 nt) | ALHGKRIYGIVALGELFTYFYMDV (SEQ ID NO: 171) |
|  | IGHV4-59*01 | 77.19% (220/285 nt) |  |  |  |
|  | IGHV4-59*02 or IGHV4-59*07 or IGHV4-61*08 | 76.84% (219/285 nt) |  |  |  |
| PGT-125 | IGHV4-b*02 | 80.21% (231/288 nt) | IGHJ5*02 | 66.67% (34/51 nt) | FDGEVLVYNHWPKPAWVDL (SEQ ID NO: 187) |
|  | IGHV4-b*01 | 79.86% (230/288 nt) | IGHJ5*01 | 64.71% (33/51 nt) |  |
|  | IGHV4-39*07 | 79.38% (231/291 nt) | IGHJ4*03 | 62.50% (30/48 nt) |  |
| PGT-126 | IGHV4-b*02 | 82.29% (237/288 nt) | IGHJ5*02 | 72.55% (37/51 nt) | FDGEVLVYHDWPKPAWVDL (SEQ ID NO: 203) |
|  | IGHV4-39*07 | 81.79% (238/291 nt) | IGHJ5*01 | 68.63% (35/51 nt) |  |
|  | IGHV4-b*01 | 81.94% (236/288 nt) | IGHJ4*03 | 64.58% (31/48 nt) |  |
| PGT-130 | IGHV4-39*07 | 79.38% (231/291 nt) | IGHJ5*02 | 72.55% (37/51 nt) | SGGDILYYYEWQKPHWFSP (SEQ ID NO: 219) |
|  | IGHV4-59*04 | 80.00% (228/285 nt) | IGHJ5*01 | 68.63% (35/51 nt) |  |
| PGT-135 | IGHV4-39*07 | 82.46% (235/285 nt) | IGHJ5*02 | 72.55% (37/51 nt) | HRHHDVFMLVPIAGWFDV (SEQ ID NO: 235) |
|  | IGHV4-39*03 | 82.04% (233/284 nt) | IGHJ5*01 | 70.59% (36/51 nt) |  |
| PGT-136 | IGHV4-39*07 | 83.86% (239/285 nt) | IGHJ5*02 | 78.43% (40/51 nt) | HKYHDIFRVVPVAGWFDP (SEQ ID NO: 252) |
|  | IGHV4-39*03 | 83.45% (237/284 nt) | IGHJ5*01 | 74.51% (38/51 nt) |  |

TABLE 43

Light Chain Germline Gene Usage for PGT-121, PGT-122, PGT-123, PGT-125, PGT-126, PGT-130, PGT-135, and PGT-136.

| mAb Clone | Germline V-gene allele | Identity to V-gene | Germline J-gene allele | Identity to J-gene | Light chain CDR3 |
|---|---|---|---|---|---|
| PGT-121 | IGLV3-21*01 or IGLV3-21*02 or IGLV3-21*03 | 81.01% (209/258 nt) | IGLJ3*02 | 86.49% (32/37 nt) | HIWDSRVPTKWV (SEQ ID NO: 152) |
| PGT-122 | IGLV3-21*02 | 82.56% (213/258 nt) | IGLJ3*02 | 81.08% (30/37 nt) | HIWDSRRPTNWV (SEQ ID NO: 164) |

TABLE 43-continued

Light Chain Germline Gene Usage for PGT-121, PGT-122, PGT-123, PGT-125, PGT-126, PGT-130, PGT-135, and PGT-136.

| mAb Clone | Germline V-gene allele | Identity to V-gene | Germline J-gene allele | Identity to J-gene | Light chain CDR3 |
|---|---|---|---|---|---|
|  | IGLV3-21*01 or IGLV3-21*03 | 82.17% (212/258 nt) |  |  |  |
| PGT-123 | IGLV3-21*01 or IGLV3-21*02 or IGLV3-21*03 | 76.74% (198/258 nt) | IGLJ3*02 | 83.78% (31/37 nt) | HIYDARGGTNWV (SEQ ID NO: 180) |
| PGT-125 | IGLV2-8*01 | 84.62% (231/273 nt) | IGLJ2*01 or IGLJ3*01 | 86.49% (32/37 nt) | GSLVGNWDVI (SEQ ID NO: 196) |
|  | IGLV2-8*02 | 84.25% (230/273 nt) |  |  |  |
| PGT-126 | IGLV2-8*01 | 91.21% (249/273 nt) | IGLJ2*01 or IGLJ3*01 | 89.19% (33/37 nt) | SSLVGNWDVI (SEQ ID NO: 212) |
|  | IGLV2-8*02 | 90.84% (248/273 nt) |  |  |  |
| PGT-130 | IGLV2-8*01 | 88.19% (254/288 nt) | IGLJ2*01 or IGLJ3*01 | 89.19% (33/37 nt) | SSLFGRWDVV (SEQ ID NO: 228) |
|  | IGLV2-8*02 | 87.85% (253/288 nt) |  |  |  |
| PGT-135 | IGKV3-15*01 | 82.44% (230/279 nt) | IGKJ1*01 | 94.44% (34/36 nt) | QQYEEWPRT (SEQ ID NO: 245) |
|  | IGKV3D-15*01 | 82.08% (229/279 nt) |  |  |  |
| PGT-136 | IGKV3-15*01 | 86.38% (241/279 nt) | IGKJ1*01 | 97.22% (35/36 nt) | QQYEEWPRT (SEQ ID NO: 245) |
|  | IGKV3D-15*01 | 86.02% (240/279 nt) |  |  |  |

Example 24: Heavy and Light Chain Usage for Selected Antibodies Isolated from B-Cell Cultures Established from Human Donors Monoclonal antibodies PGT-141 (corresponding to clones 4964_G22 and 4993_K13), PGT-142 (corresponding to clone 4995_E20), PGT-143 (corresponding to clone 4980_N08), and PGT-144 (corresponding to clone 4970_K22) are derived from related germline genes.

The similarity of the variable genes is apparent based on the gene usage (Tables 44 and 45). Although the exact gene alleles used may not be definitive, the alleles that are most likely used are provided with the percentage identity to the germline gene noted.

TABLE 44

Heavy Chain Germline Gene Usage for PGT-141, PGT-142, PGT-143, and PGT-144.

| mAb Clone | Germline V-gene allele | Identity to V-gene | Germline J-gene allele | Identity to J-gene | Heavy chain CDR3 |
|---|---|---|---|---|---|
| PGT-141 (4964_G22; 4993_K13) | IGHV1-8*01 | 84.03% (242/288 nt) | IGHJ6*02 | 74.19% (46/62 nt) | GSKHRLRDYVLYDDYGLINYQEWNDYLEFLDV (SEQ ID NO: 279) |
|  | IGHV1-2*02 or IGHV1-2*04 | 81.60% (235/288 nt) | IGHJ6*01 or IGHJ6*03 or IGHJ6*04 | 72.58% (45/62 nt) |  |

TABLE 44-continued

Heavy Chain Germline Gene Usage for PGT-141, PGT-142, PGT-143, and PGT-144.

| mAb Clone | Germline V-gene allele | Identity to V-gene | Germline J-gene allele | Identity to J-gene | Heavy chain CDR3 |
|---|---|---|---|---|---|
| PGT-142 (4995_E20) | IGHV1-8*01 | 83.68% (241/288 nt) | IGHJ6*02 | 74.19% (46/62 nt) | GSKHRLRDYVLYDDYGLINYQE WNDYLEFLDV (SEQ ID NO: 279) |
| | IGHV1-2*02 or IGHV1-2*04 | 81.60% (235/288 nt) | IGHJ6*01 or IGHJ6*03 or IGHJ6*04 | 72.58% (45/62 nt) | |
| PGT-143 (4980_N08) | IGHV1-8*01 | 84.03% (242/288 nt) | IGHJ6*02 | 74.19% (46/62 nt) | GSKHRLRDYVLYDDYGLINYQE WNDYLEFLDV (SEQ ID NO: 279) |
| | IGHV1-2*02 or IGHV1-2*04 | 81.60% (235/288 nt) | IGHJ6*01 or IGHJ6*03 or IGHJ6*04 | 72.58% (45/62 nt) | |
| PGT-144 (4970_K22) | IGHV1-8*01 | 83.33% (240/288 nt) | IGHJ6*02 or IGHJ6*01 | 74.19% (46/62 nt) | GSKHRLRDYVLYDDYGLINQQE WNDYLEFLDV (SEQ ID NO: 308) |
| | IGHV1-2*02 or IGHV1-2*04 | 80.90% (233/288 nt) | IGHJ6*03 or IGHJ6*04 | 72.58% (45/62 nt) | |

TABLE 45

Light Chain Germline Gene Usage for PGT-141, PGT-142, PGT-143, and PGT-144.

| mAb Clone | Germline V-gene allele | Identity to V-gene | Germline J-gene allele | Identity to J-gene | Light chain CDR3 |
|---|---|---|---|---|---|
| PGT-141 (4964_G22; 4993_K13) | IGKV2-28*01 or IGKV2D-28*01 | 86.05% (253/294 nt) | IGKJ1*01 | 89.19% (33/37 nt) | MQGLNRPWT (SEQ ID NO: 288) |
| PGT-142 (4995_E20) | IGKV2-28*01 or IGKV2D-28*01 | 86.05% (253/294 nt) | IGKJ1*01 | 89.19% (33/37 nt) | MQGLNRPWT (SEQ ID NO: 288) |
| PGT-143 (4980_N08) | IGKV2-28*01 or IGKV2D-28*01 | 86.05% (253/294 nt) | IGKJ1*01 | 89.19% (33/37 nt) | MQGLNRPWT (SEQ ID NO: 288) |
| PGT-144 (4970_K22) | IGKV2-28*01 or IGKV2D-28*01 | 86.73% (255/294 nt) | IGKJ1*01 | 86.49% (32/37 nt) | MQGLNRPWT (SEQ ID NO: 288) |

Example 25: Heavy and Light Chain Alignments for Selected Antibodies (PGT-141, PGT-142, PGT-143, and PGT-144)

Alignments of the genes (nucleic acid sequences) and proteins (amino acid sequence) for variable regions of both the heavy and light chains of the PGT-141, PGT-142, PGT-143, and PGT-144 antibodies are provided in Tables 46-49.

Moreover, gene relationship trees that depict the relatedness of either the heavy or light chains of these antibodies to one another are provided in FIGS. 25 and 26, respectively.

Example 26: High Through Put Functional Screening of Activated B Cells from 4 African Elite Neutralizers Yields a Panel of Novel Broadly Neutralizing Antibodies Antibodies PGT-121, PGT-122, PGT-123, PGT-125, PGT-126, PGT-130, PGT-135, PGT-136, PGT-141, PGT-142, PGT-143, and PGT-144 were generated according to the I-STAR™ Human bNAb (broadly Neutralizing Antibody) Discovery Platform depicted in FIG. 28. The isolation process involves identifying multiple neutralizing hits from IgG+ Memory B cells (as shown in FIG. 29). Once the recombinant monoclonal antibody is generated, then the neutralizing ability of the monoclonal antibody is confirmed.

As a consequence of these methods, the recombinant antibodies of the invention are highly related (as shown in Examples 21-24). Moreover, these methods identify clusters of related sequences with increased neutralization activity. Furthermore, the antibodies of the invention bind to highly conserved regions of the HIV viral spike (FIGS. 30 and 31).

Thirteen new monoclonal antibodies were isolated from 4 Protocol G elite neutralizers. Table 50 provides information regarding characteristics of each antibody.

Preliminary mapping indicates that the antibodies from donors 17, 36 and 39 provided in Table 50 define a collection of overlapping and highly conserved epitopes at the viral spike. Evidence of the overlapping nature of these epitopes is provided by, for instance, the results of competition studies (Table 54). As an example, PGT-121 and PGT-125 demonstrate strong competition for binding to the spatially overlapping epitopes.

TABLE 50

| Donor | Cluster | Mabs | HCDR3 Length | Identity to V-gene |
|---|---|---|---|---|
| 17 | #1 | 3 (PGT-121-3) | 24 | 77-80% |
| 36 | #1 | 2 (PGT-125-6) | 19 | 79-82% |
|  | #2 | 2 (PGT-130-1) | 19 | 80% |
| 39 | #1 | 1 (PGT-135) | 18 | 82% |
|  | #2 | 1 (PGT-136) | 18 | 83% |
| 84 | #1 | 4 (PGT-141-4) | 32 | 83-84% |

TABLE 51

IAVI Protocol G: elite neutralizers score ≥2.5

| Rank | Score | Country | Clade A 94UG103 | Clade B 92BR020 | Clade B JRCSF | Clade C IAVI C22 | Clade C 93IN905 | CRF01_AE 92TH021 |
|---|---|---|---|---|---|---|---|---|
| 1 | 3.67 | Ivory Coast | 900 | 900 | 2700 | 2700 | 2700 | 2700 |
| 2 | 3 | Zambia | 300 | 300 | 2700 | 300 | 2700 | 2700 |
| 5 | 2.83 | Ivory Coast | 300 | 300 | 900 | 300 | 2700 | 2700 |
| 5 | 2.83 | Ivory Coast | 300 | 900 | 2700 | 900 | 2700 | 100 |
| 5 | 2.83 | Kenya | 300 | 900 | 900 | 900 | 2700 | 300 |
| 5 | 2.83 | South Africa | 300 | 900 | 900 | 2700 | 2700 | 100 |
| 5 | 2.83 | Rwanda | 300 | 2700 | 900 | 2700 | 2700 | <100 |
| 8 | 2.69 | Zambia | 345 | 345 | 1190 | 1190 | 1190 | 345 |
| 10 | 2.67 | UK | 300 | 900 | 900 | 2700 | 900 | 100 |
| 10 | 2.67 | Zambia | 900 | 900 | 900 | 300 | 2700 | 100 |
| 10 | 2.67 | Uganda | 900 | 900 | 900 | 2700 | 900 | <100 |
| 15 | 2.5 | Ivory Coast | 300 | 900 | 300 | 900 | 900 | 300 |
| 15 | 2.5 | South Africa | 100 | 300 | 300 | 2700 | 900 | 900 |
| 15 | 2.5 | South Africa | 300 | 300 | 300 | 2700 | 2700 | 100 |
| 15 | 2.5 | UK | 300 | 900 | 300 | 900 | 900 | 300 |
| 15 | 2.5 | South Africa | 2700 | 100 | 300 | 2700 | 2700 | <100 |
| 15 | 2.5 | Uganda | 900 | 900 | 900 | 900 | 900 | <100 |
| 15 | 2.5 | Zambia | 300 | <100 | 900 | 300 | 2700 | 2700 |

Table 52 povides quantitative values for the neutralizing activity of each monoclonal antibody isolated from the 4 protocol G elite neutralizers.

TABLE 52

1050 (ug/mL)

| | Donor 17 | | | | Donor 36 | | |
|---|---|---|---|---|---|---|---|
| | PG9 | PGT121 | PGT122 | PGT123 | PGT125 | PGT126 | PGT130 |
| 92BR020 | >10 | 0.0177 | 0.0337 | 0.0130 | 0.0214 | 0.0163 | 1.1242 |
| 92RW020 | 0.1614 | 0.0063 | 0.0072 | 0.0038 | 0.0028 | 0.0046 | 0.0140 |
| 92TH021 | 0.1026 | >10 | >10 | >10 | 0.0066 | 0.1147 | 0.0082 |
| 92UG005 | >10 | >10 | >10 | 2.4924 | >10 | 0.0181 | 0.4741 |
| 92UG024 | 1.9142 | >10 | >10 | >10 | >10 | >10 | >10 |
| 93IN905 | 0.0480 | 0.0082 | 0.0138 | 0.0071 | 0.0137 | 0.0194 | 0.0182 |
| 93UG077 | >10 | 0.0459 | 0.1913 | 0.0303 | 0.0262 | 0.0256 | >10* |
| 94UG103 | 0.3098 | 1.3778 | 1.4643 | 0.8461 | 0.0124 | 0.0091 | 0.6355 |
| CMU02 | >10 | >10 | >10 | >10 | >10 | >10 | >10 |
| MGRM-C-026 | 0.1130 | 0.0034 | 0.0089 | 0.0031 | 0.0106 | 0.0076 | 0.0173 |
| APV13 | >10 | 0.3157 | 0.9923 | 0.2215 | 0.0128 | 0.0120 | 0.0345 |
| APV17 | >10 | 0.0950 | 0.5220 | 0.1798 | 7.3065 | 0.5013 | >10 |
| APV6 | 0.2139 | 0.0423 | 0.0851 | 0.0328 | 0.0359 | 0.0249 | >10 |
| JRFL | >10 | 0.0276 | 0.0471 | 0.0283 | 0.0156 | 0.0140 | 0.0346 |
| MGRM-A-010 | 0.0375 | 2.6078 | 1.6836 | 0.4921 | 0.0055 | 0.0033 | 0.0054 |
| MGRM-AG-005 | >10 | 1.1719 | >10 | 0.1036 | >10 | 1.3488 | 0.9466 |
| MGRM-C-027 | 2.4538 | 0.0094 | 0.0388 | 0.0169 | >10 | 1.1404 | 0.0052 |
| MGRM-C-028 | 0.1211 | 1.1929 | 2.0600 | 0.4433 | 5.7772 | 0.2827 | >10 |
| MGRM-D-001 | >10 | 0.7442 | 0.8673 | 0.2154 | 2.3116 | 0.0639 | >10 |
| MGRM-D-018 | 2.0444 | 0.0086 | 0.0115 | 0.0047 | 0.0382 | 0.0093 | 0.0378 |
| JRCSF | 0.0048 | 0.0343 | 0.0727 | 0.0423 | 0.0060 | 0.0061 | 0.0089 |

TABLE 52-continued

| | 1050 (µg/mL) | | | | | | |
|---|---|---|---|---|---|---|---|
| NL43 | 0.6871 | >10 | >10 | >10 | >10 | >10 | >10 |
| aMLV | >10 | >10 | >10 | >10 | >10 | >10 | >10 |
| median IC50 | 0.12 | 0.04 | 0.08 | 0.04 | 0.01 | 0.02 | 0.03 |
| % neutralized | 59 | 77 | 73 | 82 | 73 | 86 | 64 |

| | Donor 39 | | Donor 84 | | | |
|---|---|---|---|---|---|---|
| | PGT135 | PGT136 | PGT141 | PGT142 | PGT143 | PGT144 |
| 92BR020 | 0.1043 | >10 | >10 | >10 | >10 | >10 |
| 92RW020 | 0.1573 | 0.7383 | >10 | >10 | >10 | >10 |
| 92TH021 | >10 | >10 | 0.0019 | 0.0022 | 0.0028 | 0.0934 |
| 92UG005 | >10 | >10 | >10 | >10 | >10 | >10 |
| 92UG024 | 0.0139 | 0.0915 | >10 | >10 | >10 | >10 |
| 93IN905 | 0.0183 | 0.0135 | 0.0016 | 0.0017 | 0.0021 | 0.1581 |
| 93UG077 | >10 | >10 | >10 | >10 | >10 | >10 |
| 94UG103 | >10 | >10 | >10 | >10 | >10 | >10 |
| CMU02 | >10 | >10 | >10 | >10 | >10 | >10 |
| MGRM-C-026 | 0.0123 | 0.0065 | >10 | >10 | >10 | >10 |
| APV13 | 0.5452 | >10 | >10 | >10 | >10 | >10 |
| APV17 | >10 | >10 | 0.6159 | 0.3929 | 0.6179 | 5.1207 |
| APV6 | >10 | >10 | 5.0838 | 5.4170 | 4.4341 | >10 |
| JRFL | >10 | >10 | >10 | >10 | >10 | >10 |
| MGRM-A-010 | >10 | >10 | 0.0563 | 0.0578 | 0.0657 | 4.0160 |
| MGRM-AG-005 | >10 | >10 | 0.3915 | 0.2196 | 0.2441 | >10 |
| MGRM-C-027 | >10 | >10 | 0.8219 | 0.2722 | 0.5049 | >10 |
| MGRM-C-028 | 2.1608 | >10 | 2.3504 | 1.2264 | 1.8230 | >10 |
| MGRM-D-001 | >10 | >10 | >10 | >10 | >10 | >10 |
| MGRM-D-018 | 0.0433 | >10 | >10 | >10 | >10 | >10 |
| JRCSF | 0.1131 | >10 | 0.0047 | 0.0085 | 0.0064 | 0.1279 |
| NL43 | 6.7910 | >10 | 0.8562 | 0.7123 | 0.5849 | >10 |
| aMLV | >10 | >10 | >10 | >10 | >10 | >10 |
| median IC50 | 0.11 | 0.05 | 0.50 | 0.25 | 0.37 | 0.16 |
| % neutralized | 54 | 18 | 45 | 45 | 45 | 23 |

TABLE 53

Preliminary mapping of Mabs isolated from donors 17, 36, and 39: Cross competition (1)

| Donor | Cluster | mAB ID | sCD4 | b12 | 2G12 | F425/b4e8 | X5 | PG9 |
|---|---|---|---|---|---|---|---|---|
| 17 | 1 | 121 | ++ | − | +++ | +++ | + | +++ |
| | | 122 | + | − | +++ | ++ | − | +++ |
| | | 123 | + | − | +++ | +++ | − | +++ |
| 36 | 2 | 125 | ++ | − | +++ | ++ | − | + |
| | | 126 | + | − | +++ | ++ | − | + |
| | 3 | 130 | +++ | − | +++ | +++ | − | + |
| 39 | 4 | 135 | − | − | +++ | enhanced | − | − |
| | 5 | 136 | − | − | +++ | enhanced | − | − |

+++ Strong competition; ++ Moderate competition, + Weak Competition; −none

TABLE 54

| | Competitor Antibody | | | | | | | | | |
|---|---|---|---|---|---|---|---|---|---|---|
| mAb | sCD4 | b12 | 2G12 | F425 | X5 | PG9 | 121 | 125 | 130 | 135 |
| 121 | + | − | +++ | ++ | + | +++ | +++ | +++ | + | ++ |
| 122 | − | − | ++ | + | − | +++ | +++ | ++ | + | +++ |
| 123 | + | − | +++ | +++ | − | +++ | +++ | +++ | ++ | +++ |
| 125 | ++ | − | +++ | ++ | − | + | +++ | +++ | + | + |
| 126 | + | − | +++ | ++ | − | + | +++ | ++ | + | +++ |
| 127 | + | − | +++ | ++ | − | + | +++ | +++ | + | +++ |
| 128 | − | − | +++ | + | − | + | ++ | + | + | ++ |
| 130 | ++ | − | ++ | +++ | − | + | + | +++ | +++ | − |
| 131 | +++ | − | +++ | +++ | + | + | +++ | +++ | +++ | + |
| 135 | − | ++ | +++ | − | − | − | ++ | ++ | − | +++ |
| 136 | − | ++ | +++ | − | − | − | ++ | ++ | − | +++ |
| 137 | − | + | +++ | − | − | − | − | − | − | +++ |

Example 27: PGT Monoclonal Anti-HIV Antibody Potency

The potency of monoclonal anti-HIV antibodies PGT-121, PGT-122, PGT-123, PGT-125, PGT-126, PGT-127, PGT-128, PGT-130, PGT-131, PGT-135, PGT-136, PGT-137, PGT-141, PGT-142, PGT-143, PGT-144, PGT-145, and PG9 was determined against a 162 virus panel. FIG. 32 shows that the median concentration required to inhibit the activity, or neutralize, half of the virus in each panel (i.e, the half maximal inhibitory concentration (IC50), expressed in µg/ml, the mean depicted by the black bar in each column) for each antibody of the PGT group is either comparable or superior to the PG9 control.

Example 28: Isolation of Anti-HIV Antibodies PGT-127, PGT-128, PGT-131, PGT-137, and PGT-145

Antibodies of the invention may be isolated from from memory B cells in circulation as described in Walker L.M. et al, 2009, Science 326: 285-9. Specifically, surface IgG+ B cells seeded at near clonal density in 384-well microplates were activated in short-term culture. Supernatants were screened for neutralization activity against 2-4 pseudotyped viruses for which neutralization activity was detected at higher titers in the donor serum. Heavy and light chain variable regions were isolated from B cell lysates of selected neutralizing hits by reverse transcription from RNA followed by multiplex PCR amplification using family-specific V-gene primer sets. Amplicons from each lysate were uniquely tagged with multiplex identifier (MID) sequences and 454 sequencing regions (Roche). A normalized pooling of gamma, kappa and lambda chains was performed based on agarose gel image quantitation and the pool was analyzed by 454 Titanium® sequencing. Consensus sequences of the $V_H$ and $V_L$ chains were generated using the Amplicon Variant Analyzer (Roche) and assigned to specific B cell culture wells by decoding the MID tags. Clonally related sequences were identified by Clustal analysis. Selected $V_H$ and $V_L$ chains were synthesized and cloned in expression vectors with the appropriate IgG$_1$, IgK or IgL constant domain. Monoclonal antibodies were reconstituted by transient transfection in HEK293 cells followed by purification from serum-free culture supernatants.

Table 55 provides the gene usage data for the heavy chains of monoclonal anti-HIV antibodies PGT-127, PGT-128, PGT-131, PGT-137, and PGT-145.

almost 10-fold more potent than the PG9, PG16, and VRCO1 bnMAbs and 100-fold more potent than the original prototype bnMAbs (Wu, X., et al. Science 329, 856-861 (2010); Walker, L. M., et al. Science 326, 285-289 (2009); Binley, J. M., et al. J Virol 78, 13232-13252 (2004)). The MAbs largely recapitulate the neutralization breadth and potency found in the corresponding donor serum and many recognize previously undescribed epitopes on envelope (Env) glycoprotein gp120, illuminating new targets for vaccine design. Analysis of neutralization by the full complement of anti-HIV bnMAbs now available reveals that certain combinations of antibodies provide significantly more favorable coverage of the enormous diversity of global circulating viruses than others and these combinations might

TABLE 55

| Donor | mAb Clone | Germline V-gene allele | Identity to V-gene | Germline J-gene allele | Identity to J-gene | Heavy chain CDR3 |
|---|---|---|---|---|---|---|
| 196 | PGT-127 (5145_B14) | IGHV4-39*07 | 84.19% (245/291 nt) | IGHJ5*02 | 68.63% (35/51 nt) | FGGEVLVYRD WPKPAWVDL (SEQ ID NO: 322) |
|  |  | IGHV4-39*03 | 83.45% (242/290 nt) |  |  |  |
|  |  | IGHV4-39*06 | 83.51% (243/291 nt) | IGHJ5*01 | 64.71% (33/51 nt) |  |
|  |  | IGHV4-b*02 | 83.68% (241/288 nt) |  |  |  |
|  | PGT-128 (5114_A19) | IGHV4-39*07 | 79.73% (232/291 nt) | IGHJ5*02 | 74.51% (38/51 nt) | FGGEVLRYTD WPKPAWVDL (SEQ ID NO: 336) |
|  |  | IGHV4-b*01 | 79.86% (230/288 nt) |  |  |  |
|  |  | IGHV4-39*03 | 79.31% (230/290 nt) | IGHJ5*01 | 70.59% (36/51 nt) |  |
|  |  | IGHV4-b*02 | 79.51% (229/288 nt) |  |  |  |
|  | PGT-131 (5136_H01) | IGHV4-39*07 | 78.69% (229/291 nt) | IGHJ5*02 | 76.47% (39/51 nt) | SGGDILYYIEW QKPHWFYP (SEQ ID NO: 350) |
|  |  | IGHV4-28*05 | 78.69% (229/291 nt) |  |  |  |
|  |  | IGHV4-39*03 | 78.62% (228/290 nt) | GHJ5*01 | 72.55% (37/51 nt) |  |
|  |  | IGHV4-39*06 | 78.35% (228/291 nt) |  |  |  |
|  |  | IGHV4-59*04 | 78.95% (225/285 nt) |  |  |  |
| 039 | PGT-137 (5345_I01) | IGHV4-39*03 | 77.46% (220/284 nt) | IGHJ5*02 | 78.00% (39/50 nt) | HKYHDIVMVV PIAGWFDP (SEQ ID NO: 366) |
|  |  | IGHV4-39*01 or IGHV4-39*02 or IGHV4-39*07 | 77.19% (220/285 nt) | GHJ5*01 | 74.00% (37/50 nt) |  |
| 584 | PGT-145 (4995_P16) | IGHV1-8*01 | 83.33% (240/288 nt) | IGHJ3*01 | 73.47% (36/49 nt) | GSKHRLRDYFL YNEYGPNYEE WGDYLATLDV (SEQ ID NO: 380) |
|  |  |  |  | IGHJ6*02 | 66.13% (41/62 nt) |  |
|  |  | IGHV1-46*01 or IGHV1-46*02 or IGHV1-46*03 | 80.21% (231/288 nt) | IGHJ3*02 | 71.43% (35/49 nt) |  |
|  |  |  |  | IGHJ6*01 or IGHJ6*04 | 64.52% (40/62 nt) |  |

Example 29: Broad Neutralization Coverage of HIV by Multiple High Potent Antibodies Broadly cross-reactive neutralizing antibodies (bnMAbs) against highly variable viral pathogens are much sought-after to treat or protect against global circulating viruses. The neutralizing antibody repertoires of four HIV-infected donors with remarkably broad and potent neutralizing responses were probed and 17 new monoclonal antibodies (mAbs) were rescued that neutralize broadly across clades. Many of these new monoclonal anti-HIV antibodies are be sought in active or passive immunization regimes. Overall, the isolation of multiple HIV bnMAbs, from several donors, that, in aggregate, provide broad coverage at low concentrations is a highly positive indicator for the eventual design of an effective antibody-based HIV vaccine.

Most successful anti-viral vaccines elicit neutralizing antibodies as a correlate of protection (Amanna, I. J., et al. Hum Vaccin 4, 316-319 (2008); Plotkin, S.A. Pediatr Infect Dis J 20, 63-75 (2001)). For highly variable viruses, such as HIV, HCV and, to a lesser extent influenza, vaccine design efforts have been hampered by the difficulties associated with eliciting neutralizing antibodies that are effective against the enormous diversity of global circulating isolates (i.e. broadly neutralizing antibodies, also referred to as bnAbs) (Barouch, D.H. Nature 455, 613-619 (2008); Karlsson Hedestam, G. B., et al. Nat Rev Microbiol 6, 143-155 (2008)). However, for HIV for example, 10-30% of infected individuals do, in fact, develop broadly neutralizing sera, and protective bnMAbs have been isolated from infected donors (Wu, X., et al. Science 329, 856-861 (2010); Walker, L. M., et al. Science 326, 285-289 (2009); Stamatatos, L., et al. Nat Med 15, 866-870 (2009); Trkola, A., et al. J Virol 69, 6609-6617 (1995); Stiegler, G., et al. AIDS Res Hum Retroviruses 17, 1757-1765 (2001); Burton, D. R., et al. Science 266, 1024-1027 (1994); Kwong, P. D. & Wilson, I. A. Nat Immunol 10, 573-578 (2009)). It has been suggested that, given the appropriate immunogen, it should be possible to elicit these types of responses by vaccination (Schief, W. R., et al. Curr Opin HIV AIDS 4, 431-440 (2009)) and understanding the properties of bnMAbs has become a major thrust in research on highly variable viruses.

Sera from approximately 1,800 HIV-1 infected donors was previously screened for neutralization breadth and potency, designating the top 1% as "elite neutralizers", based on a score incorporating both breadth and potency (Simek, M. D., et al. J Virol 83, 7337-7348 (2009)). In this study, bnMAbs were isolated from the top four elite neutralizers (Tables 56) by screening antibody-containing memory B cell supernatants for broad neutralizing activity using a recently described high-throughput functional approach (Walker, L. M., et al. Science 326, 285-289 (2009)). Antibody variable genes were rescued from B cell cultures that displayed cross-clade neutralizing activity and expressed as full-length IgGs. Analysis of the sequences revealed that all of the mAbs isolated from each individual donor belong to a distant, but clonally related cluster of antibodies (Table 57). Since it has been proposed that antibodies from HIV-1 infected patients are often polyreactive (Haynes, B. F., et al. Science 308, 1906-1908 (2005); Mouquet, H., et al. Nature 467, 591-595 (2010)), the new mAbs were tested for binding to a panel of antigens and showed that they were not polyreactive (FIG. 36).

TABLE 56

Serum neutralizing activity of selected donors.

| Donor | presumed clade | Score | Clade A 94UG103 | Clade B 92BR020 | Clade B JRCSF | Clade C MGRM-C26 | Clade C 93IN905 | CRF01_AE 92TH021 |
|---|---|---|---|---|---|---|---|---|
| #36 | CRF02_AG | 3.67 | 900 | 900 | ≥2700 | ≥2700 | ≥2700 | ≥2700 |
| #84 | A or D | 3.00 | 300 | 300 | ≥2700 | 300 | ≥2700 | ≥2700 |
| #17 | A | 2.83 | 300 | ≥2700 | 900 | ≥2700 | ≥2700 | <100 |
| #39 | C | 2.83 | 300 | 900 | 900 | ≥2700 | ≥2700 | 100 |

TABLE 61

Neutralization activity of the newly identified PGT antibodies.

| | Median $IC_{50}$ (µg/ml) | Percent viruses neutralized | | |
|---|---|---|---|---|
| | | $IC_{50} < 50$ µg/ml | $IC_{50} < 1$ µg/ml | $IC_{50} < 0.1$ µg/ml |
| PGT121 | 0.03 | 70 | 57 | 44 |
| PGT122 | 0.05 | 65 | 48 | 36 |
| PGT123 | 0.03 | 67 | 54 | 40 |
| PGT125 | 0.04 | 52 | 40 | 32 |
| PGT126 | 0.04 | 60 | 50 | 40 |
| PGT127 | 0.08 | 50 | 37 | 27 |
| PGT128 | 0.02 | 72 | 60 | 50 |
| PGT130 | 0.16 | 52 | 35 | 23 |
| PGT131 | 0.52 | 40 | 23 | 13 |
| PGT135 | 0.17 | 33 | 23 | 13 |
| PGT136 | 7.81 | 16 | 6 | 3 |
| PGT137 | 3.46 | 22 | 8 | 4 |
| PGT141 | 0.35 | 56 | 36 | 15 |
| PGT142 | 0.21 | 57 | 40 | 23 |
| PGT143 | 0.31 | 56 | 37 | 17 |
| PGT144 | 2.06 | 38 | 16 | 3 |
| PGT145 | 0.29 | 78 | 52 | 27 |
| PG9 | 0.23 | 77 | 54 | 29 |
| VRC01 | 0.32 | 93 | 74 | 20 |
| PGV04 | 0.20 | 88 | 65 | 25 |
| b12 | 2.82 | 34 | 10 | 2 |
| 2G12 | 2.38 | 32 | 11 | 1 |
| 4E10 | 3.41 | 96 | 13 | 1 |

TABLE 57

Antibody sequence characteristics.

Heavy Chain Sequences

| Name | Donor | Putative V-gene[a] | Putative J-gene[a] | CDR3 length (amino acids)[b] | CDR3 sequence (amino acids) |
|---|---|---|---|---|---|
| PGT121 | 17 | IGHV4-59*01 | IGHJ6*03 | 24 | TLHGRRIYGIVAFNEVVFTYFYMDV |
| PGT122 | | | | | TKHGRRIYGVVAFKEVVFTYFYMDV |
| PGT123 | | | | | ALHGKRIYGIVALGELFTYFYMDV |
| PGT125 | 36 | IGHV4-39*07 | IGHJ5*02 | 19 | FDGEVLVYNHVVPKPAWVDL |
| PGT126 | | | | | FDGEVLVYHDVVPKPAWVDL |
| PGT127 | | | | | FGGEVVVYRDVVPKPAWVDL |
| PGT128 | | | | | FGGEVLRYTDVVPKPAWVDL |
| PGT130 | | | | | SGGDILYYYEWQKPHWFSP |
| PGT131 | | | | | SGGDILYYIEWQKPHVVFYP |
| PGT135 | 39 | IGHV4-39*07 | IGHJ5*02 | 18 | HRHHDVFMLVPIAGVVFDV |
| PGT136 | | | | | HKYHDIFRVVPVAGWFDP |
| PGT137 | | | | | HKYHDIVMVVPIAGWFDP |
| PGT141 | 84 | IGHV1-8*01 | IGHJ6*02 | 31/32 | GSKHRLRDYVLYDDYGLINYQEWNDYLEFLDV |
| PGT142 | | | | | GSKHRLRDYVLYDDYGLINYQEWNDYLEFLDV |
| PGT143 | | | | | GSKHRLRDYVLYDDYGLINYQEWNDYLEFLDV |
| PGT144 | | | | | GSKHRLRDYVLYDDYGLINQQEWNDYLEFLDV |
| PGT145 | | | | | GSKHRLRDYFLYNEYGPNYEEWGDYLATLDV |

Light Chain Sequences

| Name | Donor | Putative V-gene[a] | Putative J-gene[a] | CDR3 length (amino acids)[b] | CDR3 sequence (amino acids) |
|---|---|---|---|---|---|
| PGT121 | 17 | IGLV3-21*02 | IGLJ3*02 | 12 | HIWDSRVPTKWV |
| PGT122 | | | | | HIWDSRRPTNWV |
| PGT123 | | | | | HIYDARGGTNWV |
| PGT125 | 36 | IGLV2-8*01 | IGLJ2*01 or IGLJ3*01 | 10 | GSLVGNWDVI |
| PGT126 | | | | | SSLVGNWDVI |
| PGT127 | | | | | SSLVGNWDVI |
| PGT128 | | | | | GSLVGNWDVI |
| PGT130 | | | | | SSLFGRWDVV |
| PGT131 | | | | | SSLSGRWDIV |
| PGT135 | 39 | IGKV3-15*01 | IGKJ1*01 | 9 | QQYEEVVPRT |
| PGT136 | | | | | QQYEEVVPRT |
| PGT137 | | | | | QQYEEVVPRT |
| PGT141 | 84 | IGKV2-28*01 Or IGKV2D-28*01 | IGKJ1*01 | 9 | MQGLNRPWT |
| PGT142 | | | | | MQGLNRPWT |
| PGT143 | | | | | MQGLNRPWT |
| PGT144 | | | | | MQGLNRPWT |
| PGT145 | | | | | MQGLHSPWT |

Heavy Chain Sequences

| Name | Somatic mutations (nucleotides)[c] | Somatic mutations (amino acids)[c] | Mutation frequency (nucleotides)[c] | Mutation frequency (amino acids)[c] | Insertion/Deletions (number of amino acids/position) |
|---|---|---|---|---|---|
| PGT121 | 65 | 27 | 17% | 21% | |
| PGT122 | 68 | 31 | 18% | 24% | |
| PGT123 | 79 | 35 | 21% | 27% | |
| PGT125 | 78 | 36 | 20% | 27% | +6 in CDR2 |
| PGT126 | 67 | 30 | 17% | 23% | +6 in CDR2 |
| PGT127 | 58 | 30 | 15% | 23% | +6 in CDR2 |
| PGT128 | 75 | 36 | 19% | 28% | +6 in CDR2 |
| PGT130 | 83 | 42 | 22% | 34% | |
| PGT131 | 84 | 41 | 23% | 33% | |
| PGT135 | 67 | 37 | 17% | 29% | +5 IN CDR1 |
| PGT136 | 60 | 33 | 15% | 25% | +5 IN CDR1/+ 1 in CDR2 |
| PGT137 | 77 | 38 | 20% | 29% | +5 IN CDR1 |

TABLE 57-continued

Antibody sequence characteristics.

| | | | | | |
|---|---|---|---|---|---|
| PGT141 | 51 | 29 | 12% | 21% | 0 or +1 CDR3* |
| PGT142 | 51 | 31 | 12% | 23% | 0 or +1 in CDR3* |
| PGT143 | 51 | 29 | 12% | 21% | 0 or +1 in CDR3* |
| PGT144 | 59 | 33 | 14% | 24% | 0 or +1 in CDR3* |
| PGT145 | 72 | 39 | 18% | 29% | −1 or 0 in CDR3* |

Light Chain Sequences

| Name | Somatic mutations (nucleotides)[c] | Somatic mutations (amino acids)[c] | Mutation frequency (nucleotides)[c] | Mutation frequency (amino acids)[c] | Insertion/Deletions (number of amino acids/position) |
|---|---|---|---|---|---|
| PGT121 | 56 | 31 | 18% | 30% | −7 FR1/+3 in FR3 |
| PGT122 | 58 | 27 | 19% | 26% | −7 FR1/+3 in FR3 |
| PGT123 | 73 | 39 | 24% | 38% | −7 FR1/+3 in FR3 |
| PGT125 | 46 | 23 | 15% | 22% | |
| PGT126 | 28 | 14 | 9% | 13% | |
| PGT127 | 27 | 13 | 9% | 12% | |
| PGT128 | 27 | 14 | 9% | 14% | |
| PGT130 | 39 | 21 | 12% | 19% | |
| PGT131 | 44 | 25 | 13% | 23% | |
| PGT135 | 51 | 29 | 16% | 28% | |
| PGT136 | 39 | 22 | 12% | 21% | |
| PGT137 | 35 | 19 | 11% | 18% | |
| PGT141 | 46 | 23 | 14% | 21% | |
| PGT142 | 46 | 23 | 14% | 21% | |
| PGT143 | 46 | 24 | 14% | 22% | |
| PGT144 | 44 | 25 | 13% | 23% | |
| PGT145 | 52 | 26 | 16% | 24% | |

[a]Putative V- or J-gene of the common germline ancestor of each clonally related antibody cluster.
[b]CDR3 lengths according to the Kabat definition.
[c]Somatic mutations were counted over the whole variable region as nucleotides or amino acids differing from a putative germline sequence. For each cluster of clonally related antibodies, a germline sequence was composed of the putative V-gene, a consensus junction, the putative J-gene, and a consensus insertion where present. Sequences derived from 3' cloning primers were excluded from the frequency calculations.
d) Either an insertion in PGT141 to 144 or a deletion in PGT145.

The potency and breadth of the mAbs were next assessed on a 162-pseudovirus panel representing all major circulating HIV-1 subtypes (Table 58A-E and Table 61) (Walker, L. M., et al. Science 326, 285-289 (2009)). All of the mAbs exhibited cross-clade neutralizing activity, but more strikingly, several displayed exceptional potency. The median $IC_{50S}$ and $IC_{90S}$ of PGTs 121-123 and 125-128 were almost 10-fold lower (i.e. more potent) than the recently described PG9, PG16, VRC01, and PGV04 bnMAbs (Wu, X., et al. Science 329, 856-861 (2010); Walker, L. M., et al. Science 326, 285-289 (2009)) and approximately 100-fold lower than other bnMAbs described earlier (Table 61). At concentrations less than 0.1 µg/ml, these mAbs still neutralized 27% to 50% of viruses in the panel (Table 61 and FIG. 33b). Although PGTs 135, 136, and 137 displayed a lesser degree of overall neutralization breadth relative to the other mAbs, they all still neutralized over 30% of the clade C viruses on the panel (FIG. 36 and Table 58A). These results are significant considering that HIV-1 clade C predominates in sub-Saharan Africa and accounts for more than 50% of all HIV-1 infections worldwide.

TABLE 58A

Neutralizing activity of PGT mAbs against a cross-clade 162-pseudovirus panel.

A) Median $IC_{50}$ (µg/ml) against viruses neutralized with an $IC_{50}$ <50 µg/ml[3]

| Clade | n | PGT121 | PGT122 | PGT123 | PGT125 | PGT126 | PGT127 | PGT128 | PGT130 | PGT131 | PGT135 | PGT136 |
|---|---|---|---|---|---|---|---|---|---|---|---|---|
| A | 26 | 0.02 | 0.07 | 0.02 | 0.01 | 0.01 | 0.02 | 0.01 | 0.09 | 0.09 | 0.64 | 234 |
| B | 31 | 0.02 | 0.02 | 0.02 | 0.02 | 0.02 | 0.06 | 0.01 | 0.09 | 0.07 | 0.15 | 13.19 |
| C | 27 | 0.02 | 0.03 | 0.01 | 1.83 | 0.18 | 0.55 | 0.04 | 0.15 | 0.78 | 0.05 | 7.52 |
| D | 25 | 0.01 | 0.02 | 0.02 | 0.09 | 0.04 | 0.49 | 0.02 | 0.65 | 0.85 | 1.09 | 0.05 |
| F | 15 | 0.13 | 0.43 | 0.09 | 0.04 | 0.06 | 0.65 | 0.52 | 0.07 | 0.56 | 0.21 | 4.75 |
| G | 15 | 0.02 | 0.05 | 0.04 | 0.02 | 0.18 | 0.22 | 0.04 | 4.14 | 3.54 | 0.14 | 18.95 |
| AE | 10 | na | na | na | 0.03 | 1.77 | na | 0.06 | 0.17 | 0.08 | na | na |
| AG | 10 | 0.49 | 2.75 | 0.61 | 0.01 | 0.03 | 0.04 | 0.67 | 0.04 | 0.18 | 27.37 | 29.11 |
| All | 162 | 0.03 | 0.05 | 0.03 | 0.04 | 0.04 | 0.08 | 0.02 | 0.18 | 0.52 | 0.17 | 7.81 |

| Clade | PGT137 | PGT141 | PGT142 | PGT143 | PGT144 | PGT145 | PG9 | VRC01 | PGV04 | b12 | 2G12 | 4E10 |
|---|---|---|---|---|---|---|---|---|---|---|---|---|
| A | 0.72 | 0.22 | 0.25 | 0.27 | 2.81 | 0.40 | 0.12 | 0.26 | 0.14 | 6.98 | 17.20 | 5.50 |
| B | 8.55 | 0.48 | 0.40 | 0.39 | 3.37 | 0.09 | 0.43 | 0.24 | 0.17 | 0.80 | 0.82 | 5.79 |

TABLE 58A-continued

Neutralizing activity of PGT mAbs against a cross-clade 162-pseudovirus panel.

| | | | | | | | | | | | | |
|---|---|---|---|---|---|---|---|---|---|---|---|---|
| C | 0.23 | 0.33 | 0.09 | 0.17 | 0.85 | 0.14 | 0.23 | 0.48 | 0.79 | 5.46 | 2.50 | 3.98 |
| D | 6.30 | 0.37 | 0.19 | 0.28 | 2.13 | 1.07 | 0.10 | 0.44 | 0.44 | 1.47 | 4.57 | 4.54 |
| F | 6.23 | 0.24 | 0.22 | 0.36 | 0.51 | 0.82 | 0.09 | 0.39 | 0.18 | na | 9.23 | 2.26 |
| G | 0.23 | 0.30 | 0.21 | 0.21 | 3.84 | 0.11 | 0.27 | 0.10 | 0.06 | 2.99 | 31.03 | 1.44 |
| AE | na | 0.01 | 0.01 | 0.02 | 0.10 | 0.97 | 0.10 | 0.36 | 1.24 | 21.07 | na | 0.63 |
| AG | 28.30 | 0.50 | 2.16 | 1.11 | 18.02 | 0.16 | 0.36 | 0.12 | 0.10 | 10.40 | 0.95 | 1.42 |
| All | 3.48 | 0.35 | 0.21 | 0.31 | 2.06 | 0.29 | 0.23 | 0.32 | 0.20 | 2.82 | 2.38 | 3.41 |

B) Percent viruses neutralized with an $IC_{50}$ <50 µg/ml[3]

| Clade | n | PGT121 | PGT122 | PGT123 | PGT125 | PGT126 | PGT127 | PGT128 | PGT130 | PGT131 | PGT135 | PGT136 |
|---|---|---|---|---|---|---|---|---|---|---|---|---|
| A | 26 | 62 | 58 | 58 | 65 | 50 | 50 | 50 | 50 | 38 | 19 | 4 |
| B | 31 | 84 | 84 | 81 | 74 | 81 | 81 | 81 | 65 | 45 | 39 | 19 |
| C | 27 | 85 | 81 | 85 | 56 | 74 | 52 | 78 | 48 | 41 | 37 | 33 |
| D | 25 | 48 | 40 | 48 | 40 | 52 | 48 | 60 | 44 | 36 | 24 | 4 |
| F | 15 | 80 | 80 | 80 | 20 | 33 | 27 | 80 | 33 | 13 | 60 | 13 |
| G | 15 | 80 | 80 | 80 | 27 | 33 | 40 | 67 | 47 | 40 | 40 | 27 |
| AE | 10 | 0 | 0 | 0 | 60 | 40 | 0 | 60 | 80 | 60 | 0 | 0 |
| AG | 10 | 70 | 60 | 60 | 30 | 50 | 40 | 90 | 50 | 40 | 20 | 10 |
| All | 162 | 70 | 65 | 87 | 52 | 60 | 50 | 72 | 52 | 40 | 33 | 18 |

| Clade | PGT137 | PGT141 | PGT142 | PGT143 | PGT144 | PGT145 | PG9 | VRC01 | PGV04 | b12 | 2G12 | 4E10 |
|---|---|---|---|---|---|---|---|---|---|---|---|---|
| A | 23 | 66 | 69 | 65 | 46 | 81 | 85 | 92 | 100 | 31 | 35 | 96 |
| B | 19 | 52 | 52 | 52 | 39 | 77 | 74 | 100 | 94 | 58 | 71 | 97 |
| C | 33 | 70 | 70 | 70 | 52 | 70 | 67 | 89 | 70 | 26 | 11 | 89 |
| D | 12 | 28 | 28 | 28 | 16 | 72 | 76 | 84 | 76 | 48 | 24 | 96 |
| F | 20 | 67 | 67 | 67 | 33 | 100 | 67 | 100 | 93 | 0 | 20 | 93 |
| G | 33 | 67 | 67 | 67 | 33 | 80 | 80 | 93 | 87 | 13 | 20 | 100 |
| AE | 0 | 40 | 40 | 40 | 30 | 90 | 100 | 100 | 90 | 40 | 0 | 100 |
| AG | 10 | 50 | 60 | 50 | 20 | 70 | 80 | 90 | 100 | 30 | 50 | 100 |
| All | 22 | 56 | 57 | 58 | 38 | 78 | 77 | 90 | 88 | 34 | 32 | 96 |

C) Median $IC_{50}$ (µg/ml) against all viruses[3]

| Clade | n | PGT121 | PGT122 | PGT123 | PGT125 | PGT126 | PGT127 | PGT028 | PGT130 | PGT131 | PGT135 | PGT136 |
|---|---|---|---|---|---|---|---|---|---|---|---|---|
| A | 26 | 0.87 | 3.69 | 0.69 | 0.16 | 2.62 | 21.71 | 0.35 | 41.39 | 50.00 | 50.00 | 50.00 |
| B | 31 | 0.03 | 0.05 | 0.04 | 0.06 | 0.04 | 0.12 | 0.02 | 5.17 | 50.00 | 50.00 | 50.00 |
| C | 27 | 0.02 | 0.04 | 0.02 | 37.48 | 0.79 | 19.19 | 0.08 | 50.00 | 50.00 | 50.00 | 50.00 |
| D | 25 | 50.00 | 50.00 | 50.00 | 50.00 | 43.14 | 50.00 | 0.14 | 50.00 | 50.00 | 50.00 | 50.00 |
| F | 15 | 0.17 | 1.29 | 0.31 | 50.00 | 50.00 | 50.00 | 1.21 | 50.00 | 50.00 | 7.79 | 50.00 |
| G | 15 | 0.06 | 0.51 | 0.18 | 50.00 | 48.85 | 50.00 | 0.32 | 50.00 | 50.00 | 50.00 | 50.00 |
| AE | 10 | 50.00 | 50.00 | 50.00 | 1.61 | 50.00 | 50.00 | 0.31 | 0.58 | 2.60 | 50.00 | 50.00 |
| AG | 10 | 0.60 | 38.45 | 8.04 | 50.00 | 11.07 | 50.00 | 1.62 | 21.75 | 50.00 | 50.00 | 50.00 |
| All | 162 | 0.31 | 2.02 | 0.35 | 34.07 | 1.08 | 42.83 | 0.10 | 22.08 | 50.00 | 50.00 | 50.00 |

| Clade | PGT137 | PGT141 | PGT142 | PGT143 | PGT144 | PGT145 | PG9 | VRC01 | PGV04 | b12 | 2G12 | 4E10 |
|---|---|---|---|---|---|---|---|---|---|---|---|---|
| A | 50.00 | 1.92 | 2.21 | 6.34 | 50.00 | 1.16 | 0.21 | 0.28 | 0.14 | 50.00 | 50.00 | 6.79 |
| B | 50.00 | 33.21 | 15.15 | 25.89 | 50.00 | 0.34 | 2.08 | 0.24 | 0.25 | 4.17 | 1.90 | 5.76 |
| C | 50.00 | 3.28 | 0.79 | 0.80 | 48.89 | 0.49 | 0.57 | 0.71 | 2.76 | 50.00 | 50.00 | 3.98 |
| D | 50.00 | 50.00 | 50.00 | 50.00 | 50.00 | 10.00 | 1.91 | 0.58 | 1.01 | 50.00 | 50.00 | 5.30 |
| F | 50.00 | 1.15 | 0.82 | 0.98 | 29.56 | 0.82 | 0.58 | 0.39 | 0.18 | 50.00 | 50.00 | 2.26 |
| G | 50.00 | 4.69 | 5.95 | 4.77 | 50.00 | 0.21 | 0.51 | 0.12 | 0.13 | 50.00 | 50.00 | 1.44 |
| AE | 50.00 | 50.00 | 50.00 | 50.00 | 50.00 | 1.17 | 0.10 | 0.56 | 1.26 | 50.00 | 50.00 | 0.63 |
| AG | 50.00 | 31.02 | 16.43 | 41.24 | 50.00 | 1.27 | 3.47 | 0.16 | 0.10 | 50.00 | 14.00 | 1.42 |
| All | 50.00 | 18.01 | 9.46 | 13.76 | 50.00 | 0.88 | 0.82 | 0.34 | 0.30 | 50.00 | 50.00 | 3.50 |

D) Median $IC_{50}$ (µg/ml) against viruses neutralized with an $IC_{50}$ <50 µg/ml[3]

| Clade | n | PGT121 | PGT122 | PGT123 | PGT125 | PGT126 | PGT127 | PGT128 | PGT130 | PGT131 | PGT135 | PGT136 |
|---|---|---|---|---|---|---|---|---|---|---|---|---|
| A | 26 | 0.20 | 0.33 | 0.18 | 0.07 | 0.06 | 0.16 | 0.04 | 4.99 | 0.73 | 1.01 | na |
| B | 31 | 0.11 | 0.15 | 0.14 | 0.13 | 0.17 | 0.36 | 0.07 | 0.77 | 0.50 | 2.87 | 2.09 |
| C | 27 | 0.12 | 0.17 | 0.08 | 0.18 | 0.96 | 7.99 | 0.17 | 2.67 | 15.80 | 0.28 | 0.28 |
| D | 25 | 0.12 | 0.11 | 0.13 | 0.87 | 0.33 | 0.18 | 0.12 | 3.18 | 2.67 | 1.13 | 2.10 |
| F | 15 | 1.17 | 5.53 | 0.74 | 0.37 | 1.00 | 0.86 | 1.17 | 4.84 | 1.92 | 1.26 | na |
| G | 15 | 0.22 | 0.65 | 0.19 | 0.05 | 0.17 | 0.67 | 0.12 | 28.06 | na | 1.01 | 7.54 |
| AE | 10 | na | na | na | 0.22 | 19.58 | na | 1.47 | 0.08 | 0.21 | na | na |
| AG | 10 | 0.56 | 0.97 | 2.27 | 0.05 | 0.06 | 0.24 | 0.13 | 0.07 | 0.16 | na | na |
| All | 162 | 0.13 | 0.26 | 0.18 | 0.78 | 0.17 | 0.46 | 0.32 | 1.88 | 0.54 | 1.13 | 2.00 |

| Clade | PGT137 | PGT141 | PGT142 | PGT143 | PGT144 | PGT145 | PG9 | VRC01 | PGV04 | b12 | 2G12 | 4E10 |
|---|---|---|---|---|---|---|---|---|---|---|---|---|
| A | 2.54 | 2.88 | 2.37 | 1.57 | 4.31 | 4.30 | 2.24 | 2.20 | 1.45 | 48.45 | 17.77 | 40.61 |
| B | na | 4.62 | 9.52 | 2.84 | 7.06 | 0.54 | 2.00 | 2.05 | 1.06 | 5.96 | 4.52 | 30.31 |

TABLE 58A-continued

Neutralizing activity of PGT mAbs against a cross-clade 162-pseudovirus panel.

| | | | | | | | | | | | |
|---|---|---|---|---|---|---|---|---|---|---|---|
| C | 1.32 | 3.83 | 1.69 | 2.02 | 12.43 | 1.76 | 7.00 | 6.18 | 3.83 | 27.42 | 28.67 | 21.21 |
| D | 16.10 | 25.10 | 9.75 | 8.36 | 19.06 | 5.27 | 0.80 | 5.72 | 3.23 | 12.08 | 8.77 | 23.46 |
| F | 21.09 | 4.55 | 3.45 | 6.08 | 7.79 | 9.74 | 0.52 | 2.72 | 2.34 | na | 21.50 | 7.63 |
| G | 1.45 | 1.58 | 1.99 | 1.85 | 7.57 | 2.18 | 6.35 | 1.44 | 1.74 | 22.81 | na | 16.57 |
| AE | na | 0.03 | 0.03 | 0.05 | 3.41 | 11.09 | 1.02 | 4.08 | 8.18 | 12.08 | na | 12.96 |
| AG | na | 3.66 | 5.15 | 4.97 | na | 0.87 | 0.36 | 1.17 | 1.97 | 16.96 | 7.04 | 15.36 |
| All | 2.10 | 3.80 | 3.75 | 2.60 | 8.37 | 2.10 | 1.22 | 2.70 | 2.00 | 18.01 | 8.06 | 22.37 |

E) Percent viruses neutralized with an IC$_{50}$ <50 μg/ml$^3$

| Clade | n | PGT121 | PGT122 | PGT123 | PGT125 | PGT126 | PGT127 | PGT128 | PGT130 | PGT131 | PGT135 | PGT136 |
|---|---|---|---|---|---|---|---|---|---|---|---|---|
| A | 26 | 50 | 50 | 50 | 54 | 50 | 46 | 50 | 31 | 23 | 4 | 0 |
| B | 31 | 81 | 77 | 77 | 58 | 74 | 05 | 77 | 42 | 29 | 23 | 3 |
| C | 27 | 67 | 59 | 63 | 26 | 48 | 38 | 67 | 26 | 21 | 33 | 13 |
| D | 25 | 36 | 32 | 32 | 28 | 36 | 28 | 48 | 16 | 8 | 8 | 4 |
| F | 15 | 00 | 73 | 53 | 20 | 27 | 13 | 53 | 20 | 7 | 33 | 0 |
| G | 15 | 00 | 00 | 47 | 7 | 20 | 20 | 47 | 7 | 0 | 20 | 7 |
| AE | 10 | 0 | 0 | 0 | 40 | 20 | 0 | 50 | 50 | 40 | 0 | 0 |
| AG | 10 | 30 | 30 | 40 | 30 | 30 | 30 | 50 | 30 | 20 | 0 | 0 |
| All | 162 | 56 | 54 | 52 | 37 | 46 | 36 | 57 | 28 | 10 | 17 | 5 |

| Clade | PGT137 | PGT141 | PGT142 | PGT143 | PGT144 | PGT145 | PG9 | VRC01 | PGV04 | b12 | 2G12 | 4E10 |
|---|---|---|---|---|---|---|---|---|---|---|---|---|
| A | 12 | 38 | 46 | 35 | 4 | 46 | 69 | 88 | 88 | 4 | 4 | 23 |
| B | 0 | 32 | 39 | 29 | 13 | 61 | 29 | 100 | 84 | 45 | 52 | 16 |
| C | 21 | 48 | 58 | 50 | 29 | 58 | 48 | 81 | 48 | 17 | 4 | 42 |
| D | 4 | 20 | 20 | 16 | 8 | 36 | 40 | 72 | 56 | 28 | 12 | 20 |
| F | 7 | 47 | 53 | 47 | 27 | 67 | 40 | 100 | 93 | 0 | 7 | 40 |
| G | 13 | 33 | 47 | 40 | 7 | 67 | 40 | 93 | 87 | 13 | 0 | 53 |
| AE | 00 | 30 | 30 | 30 | 20 | 60 | 70 | 100 | 80 | 10 | 0 | 70 |
| AG | 0 | 20 | 30 | 20 | 0 | 50 | 40 | 90 | 100 | 10 | 30 | 60 |
| All | 7 | 36 | 40 | 33 | 14 | 53 | 48 | 80 | 77 | 10 | 15 | 34 |

F) Median IC$_{50}$ (μg/ml) against all viruses$^3$

| Clade | n | PGT121 | PGT122 | PGT123 | PGT125 | PGT126 | PGT127 | PGT128 | PGT130 | PGT131 | PGT135 | PGT136 |
|---|---|---|---|---|---|---|---|---|---|---|---|---|
| A | 26 | 47.89 | 48.07 | 23.26 | 26.63 | 6.27 | 50.00 | 9.38 | 50.00 | 50.00 | 50.00 | 50.00 |
| B | 31 | 0.23 | 0.41 | 0.42 | 0.49 | 0.29 | 1.17 | 0.12 | 50.00 | 50.00 | 50.00 | 50.00 |
| C | 27 | 0.47 | 7.99 | 7.29 | 50.00 | 50.00 | 50.00 | 2.54 | 50.00 | 50.00 | 50.00 | 50.00 |
| D | 25 | 50.00 | 50.00 | 50.00 | 50.00 | 50.00 | 50.00 | 50.00 | 50.00 | 50.00 | 50.00 | 50.00 |
| F | 15 | 1.86 | 23.47 | 5.05 | 50.00 | 50.00 | 50.00 | 38.14 | 50.00 | 50.00 | 50.00 | 50.00 |
| G | 15 | 2.10 | 26.35 | 50.00 | 50.00 | 50.00 | 50.00 | 50.00 | 50.00 | 50.00 | 50.00 | 50.00 |
| AE | 10 | 50.00 | 50.00 | 50.00 | 50.00 | 50.00 | 50.00 | 29.21 | 50.00 | 50.00 | 50.00 | 50.00 |
| AG | 10 | 50.00 | 50.00 | 50.00 | 50.00 | 50.00 | 50.00 | 42.87 | 50.00 | 50.00 | 50.00 | 50.00 |
| All | 162 | 10.40 | 38.11 | 18.25 | 50.00 | 50.00 | 50.00 | 2.73 | 50.00 | 50.00 | 50.00 | 50.00 |

| Clade | PGT137 | PGT141 | PGT142 | PGT143 | PGT144 | PGT145 | PG9 | VRC01 | PGV04 | b12 | 2G12 | 4E10 |
|---|---|---|---|---|---|---|---|---|---|---|---|---|
| A | 50.00 | 50.00 | 50.00 | 50.00 | 50.00 | 50.00 | 2.71 | 2.38 | 1.62 | 50.00 | 50.00 | 50.00 |
| B | 50.00 | 50.00 | 50.00 | 50.00 | 50.00 | 6.51 | 50.00 | 2.05 | 2.05 | 50.00 | 44.23 | 50.00 |
| C | 50.00 | 50.00 | 43.11 | 50.00 | 50.00 | 30.57 | 22.11 | 6.71 | 50.00 | 50.00 | 50.00 | 50.00 |
| D | 50.00 | 50.00 | 50.00 | 50.00 | 50.00 | 50.00 | 50.00 | 8.77 | 7.58 | 50.00 | 50.00 | 50.00 |
| F | 50.00 | 50.00 | 34.51 | 50.00 | 50.00 | 16.34 | 50.00 | 2.72 | 2.52 | 50.00 | 50.00 | 50.00 |
| G | 50.00 | 50.00 | 50.00 | 50.00 | 50.00 | 9.93 | 50.00 | 1.69 | 2.07 | 50.00 | 50.00 | 29.65 |
| AE | 50.00 | 50.00 | 50.00 | 50.00 | 50.00 | 39.37 | 0.78 | 4.08 | 11.00 | 50.00 | 50.00 | 19.49 |
| AG | 50.00 | 50.00 | 50.00 | 50.00 | 50.00 | 35.44 | 50.00 | 1.40 | 1.97 | 50.00 | 50.00 | 26.15 |
| All | 50.00 | 50.00 | 50.00 | 50.00 | 50.00 | 31.20 | 46.50 | 3.31 | 4.11 | 50.00 | 50.00 | 50.00 |

TABLE 58B

| | | IC$_{50}$ (μg/mL)$^a$ | | | | | |
|---|---|---|---|---|---|---|---|
| Isolate | Subtype | PGT-121 | PGT-122 | PGT-123 | PGT-125 | PGT-126 | PGT-127 |
| 92RW008 | A | 0.003 | 0.003 | 0.003 | 0.004 | 0.008 | 0.012 |
| 92WR009 | | 1.739 | 42.406 | 15.680 | 0.144 | >50 | >50 |
| 92WR020 | | 0.004 | 0.009 | 0.002 | 0.004 | 0.006 | 0.010 |
| 92WR021 | | 0.009 | 0.021 | 0.005 | 0.005 | 0.006 | 0.011 |
| 92WR024 | | >50 | >50 | >50 | 35.530 | 41.995 | >50 |
| 92WR026 | | 0.014 | 0.036 | 0.012 | 0.007 | 0.008 | 0.024 |
| 92UG031 | | >50 | >50 | >50 | >50 | >50 | >50 |
| 92UG037 | | 0.031 | 0.068 | 0.023 | 0.005 | 0.011 | 0.014 |
| 93WR029 | | >50 | >50 | >50 | >50 | >50 | >50 |

TABLE 58B-continued

| Isolate | | PGT-121 | PGT-123 | PGT-125 | PGT-126 | PGT-127 | PGT-128 |
|---|---|---|---|---|---|---|---|
| 93UG077 | | 0.019 | 0.084 | 0.028 | 0.012 | 0.020 | 0.055 |
| 94UG103 | | 2.518 | 2.041 | 0.678 | 0.008 | 0.008 | 0.017 |
| MG RM-A-001 | | >50 | >50 | >50 | 12.392 | >50 | >50 |
| MG RM-A-002 | | 0.013 | 0.017 | 0.011 | 0.013 | 0.015 | 9.422 |
| MG RM-A-003 | | 0.435 | 3.794 | 0.495 | >50 | >50 | >50 |
| MG RM-A-004 | | >50 | >50 | >50 | >50 | >50 | >50 |
| MG RM-A-005 | | >50 | >50 | >50 | >50 | >50 | >50 |
| MG RM-A-006 | | 0.396 | >50 | >50 | >50 | >50 | >50 |
| MG RM-A-007 | | >50 | >50 | >50 | >50 | >50 | >50 |
| MG RM-A-008 | | >50 | >50 | >50 | >50 | >50 | >50 |
| MG RM-A-009 | | 0.006 | 0.012 | 0.004 | 0.009 | 0.004 | 0.013 |
| MG RM-A-010 | | 2.444 | 2.509 | 0.705 | 0.004 | 0.002 | 0.017 |
| MG RM-A-011 | | >50 | >50 | >50 | >50 | >50 | >50 |
| MG RM-A-012 | | 0.092 | 0.257 | 0.192 | 0.177 | 0.097 | 0.105 |
| MG RM-A-013 | | 0.387 | 2.474 | 0.565 | 0.014 | 0.006 | 0.029 |
| MG RM-A-014 | | 0.003 | 0.007 | 0.003 | 13.913 | 0.010 | 0.240 |
| VLGCA1 | | >50 | >50 | >50 | 0.078 | >50 | >50 |
| 94 KE 105 | AC | 0.029 | 0.056 | 0.024 | 0.004 | 0.006 | 0.023 |
| 92TH021 | AE | >50 | >50 | >50 | 0.006 | 0.197 | >50 |
| CMU02 | | >50 | >50 | >50 | >50 | >50 | >50 |
| MGRM-AE-001 | | >50 | >50 | >50 | 2.948 | 9.684 | >50 |
| MGRM-AE-002 | | >50 | >50 | >50 | >50 | >50 | >50 |
| MGRM-AE-003 | | >50 | >50 | >50 | 0.092 | >50 | >50 |
| MGRM-AE-004 | | >50 | >50 | >50 | >50 | >50 | >50 |
| MGRM-AE-005 | | >50 | >50 | >50 | 0.010 | 0.324 | >50 |
| MGRM-AE-006 | | >50 | >50 | >50 | 0.009 | 17.268 | >50 |
| MGRM-AE-007 | | >50 | >50 | >50 | 0.876 | >50 | >50 |
| MGRM-AE-008 | | >50 | >50 | >50 | >50 | >50 | >50 |
| MG RM-AG-001 | AG | 2.096 | 14.472 | 2.509 | >50 | >50 | >50 |
| MG RM-AG-002 | | >50 | >50 | >50 | >50 | >50 | >50 |
| MG RM-AG-003 | | 0.465 | 43.663 | >50 | >50 | >50 | >50 |
| MG RM-AG-005 | | 0.649 | 33.861 | 0.149 | >50 | 1.207 | >50 |
| MG RM-AG-006 | | 0.014 | 0.028 | 0.014 | 0.008 | 0.010 | 0.021 |
| MG RM-AG-008 | | 0.494 | >50 | 19.162 | >50 | >50 | >50 |
| MG RM-AG-009 | | 0.080 | 0.128 | 0.073 | 0.026 | 0.030 | 0.059 |
| MG RM-AG-011 | | >50 | >50 | >50 | >50 | 24.51 | >50 |
| MG RM-AG-012 | | >50 | >50 | >50 | >50 | >50 | >50 |
| MG RM-AG-013 | | 0.557 | 0.521 | 3.371 | 0.004 | 0.008 | 0.018 |

| | IC$_{50}$ (μg/mL)$^a$ | | | | | |
|---|---|---|---|---|---|---|
| Isolate | PGT-128 | PGT-130 | PGT-131 | PGT-135 | PGT-136 | PGT-137 |
| 92RW008 | 0.003 | 0.089 | 1.011 | 1.417 | >50 | 0.148 |
| 92WR009 | 0.812 | 1.274 | 3.115 | >50 | >50 | >50 |
| 92WR020 | 0.005 | 0.039 | 0.168 | 0.067 | 2.335 | 0.005 |
| 92WR021 | 0.005 | 0.004 | 0.012 | >50 | >50 | 3.516 |
| 92WR024 | >50 | >50 | >50 | >50 | >50 | >50 |
| 92WR026 | 0.010 | 0.037 | 0.041 | 0.068 | >50 | 0.092 |
| 92UG031 | >50 | >50 | >50 | >50 | >50 | >50 |
| 92UG037 | 0.006 | 0.061 | 0.048 | 3.672 | >50 | >50 |
| 93WR029 | >50 | 34.264 | >50 | >50 | >50 | >50 |
| 93UG077 | 0.014 | 21.392 | >50 | >50 | >50 | >50 |
| 94UG103 | 0.011 | 1.402 | 1.097 | >50 | >50 | >50 |
| MG RM-A-001 | >50 | >50 | >50 | >50 | >50 | >50 |
| MG RM-A-002 | 0.149 | 0.010 | >50 | >50 | >50 | >50 |
| MG RM-A-003 | >50 | >50 | >50 | >50 | >50 | >50 |
| MG RM-A-004 | >50 | >50 | >50 | >50 | >50 | >50 |
| MG RM-A-005 | >50 | >50 | >50 | >50 | >50 | >50 |
| MG RM-A-006 | >50 | >50 | >50 | >50 | >50 | >50 |
| MG RM-A-007 | >50 | >50 | >50 | >50 | >50 | >50 |
| MG RM-A-008 | >50 | >50 | >50 | >50 | >50 | >50 |
| MG RM-A-009 | 0.005 | 0.308 | 0.035 | >50 | >50 | >50 |
| MG RM-A-010 | 0.005 | 0.005 | 0.010 | >50 | >50 | >50 |
| MG RM-A-011 | >50 | >50 | >50 | >50 | >50 | >50 |
| MG RM-A-012 | 0.025 | >50 | >50 | >50 | >50 | >50 |
| MG RM-A-013 | 0.008 | >50 | >50 | >50 | >50 | 49.188 |
| MG RM-A-014 | 0.007 | 0.161 | 15.444 | 0.636 | >50 | 18.576 |
| VLGCA1 | 0.838 | >50 | >50 | >50 | >50 | >50 |
| 94 KE 105 | 0.007 | 0.004 | 0.013 | 0.063 | >50 | 18.548 |
| 92TH021 | 0.010 | 0.009 | 0.014 | >50 | >50 | >50 |
| CMU02 | >50 | >50 | >50 | >50 | >50 | >50 |
| MGRM-AE-001 | 0.069 | 1.005 | 4.805 | >50 | >50 | >50 |
| MGRM-AE-002 | 0.522 | 1.534 | >50 | >50 | >50 | >50 |
| MGRM-AE-003 | 0.180 | 0.337 | 1.407 | >50 | >50 | >50 |
| MGRM-AE-004 | >50 | 2.429 | >50 | >50 | >50 | >50 |
| MGRM-AE-005 | 0.032 | 0.006 | 0.017 | >50 | >50 | >50 |
| MGRM-AE-006 | 0.044 | 0.009 | 0.026 | >50 | >50 | >50 |
| MGRM-AE-007 | >50 | 0.083 | 0.026 | >50 | >50 | >50 |
| MGRM-AE-008 | >50 | >50 | >50 | >50 | >50 | >50 |

TABLE 58B-continued

| | | | | | | |
|---|---|---|---|---|---|---|
| MG RM-AG-001 | 4.730 | >50 | >50 | >50 | >50 | >50 |
| MG RM-AG-002 | 4.987 | >50 | >50 | >50 | >50 | >50 |
| MG RM-AG-003 | 34.787 | 0.041 | 2.917 | >50 | >50 | >50 |
| MG RM-AG-005 | 0.037 | 0.540 | 1.041 | >50 | >50 | >50 |
| MG RM-AG-006 | 0.009 | 0.009 | 0.019 | 17.890 | 29.108 | 28.298 |
| MG RM-AG-008 | 0.668 | >50 | >50 | >50 | >50 | >50 |
| MG RM-AG-009 | 0.021 | 9.461 | >50 | >50 | >50 | >50 |
| MG RM-AG-011 | 3.931 | >50 | >50 | >50 | >50 | >50 |
| MG RM-AG-012 | >50 | >50 | >50 | 41.885 | >50 | >50 |
| MG RM-AG-013 | 0.004 | 0.010 | 0.030 | >50 | >50 | >50 |

| | | IC$_{50}$ (µg/mL)$^a$ | | | | |
|---|---|---|---|---|---|---|
| Isolate | Subtype | PGT-141 | PGT-142 | PGT-143 | PGT-144 | PGT-145 | VRC01 |
| 92RW008 | A | 0.579 | 0.447 | 0.385 | >50 | 0.400 | 0.037 |
| 92WR009 | | 0.022 | 0.006 | 0.010 | 0.893 | 0.026 | 0.187 |
| 92WR020 | | >50 | 31.523 | >50 | >50 | 0.997 | 0.130 |
| 92WR021 | | >50 | >50 | >50 | >50 | 1.620 | 0.066 |
| 92WR024 | | 0.175 | 0.069 | 0.122 | 16.346 | 0.069 | 0.327 |
| 92WR026 | | 1.781 | 1.780 | 5.364 | 32.691 | 1.453 | N/A |
| 92UG031 | | 0.093 | 0.050 | 0.095 | 2.175 | 3.220 | 0.469 |
| 92UG037 | | 1.276 | 0.557 | 0.854 | 8.241 | 3.148 | 0.245 |
| 93WR029 | | 0.019 | 0.014 | 0.053 | 4.391 | >50 | 1.570 |
| 93UG077 | | >50 | >50 | >50 | >50 | >50 | 0.097 |
| 94UG103 | | >50 | >50 | >50 | >50 | 0.331 | 0.285 |
| MG RM-A-001 | | 0.209 | 0.169 | 0.274 | 1.111 | 0.062 | >50 |
| MG RM-A-002 | | 0.217 | 0.007 | 0.016 | 0.085 | 0.019 | N/A |
| MG RM-A-003 | | 7.961 | 9.239 | 11.154 | >50 | 3.315 | 0.422 |
| MG RM-A-004 | | 0.007 | 0.002 | 0.007 | 0.855 | 0.068 | 1.064 |
| MG RM-A-005 | | 11.112 | 9.695 | 7.483 | 18.590 | 0.128 | 0.095 |
| MG RM-A-006 | | >50 | >50 | >50 | >50 | >50 | 0.521 |
| MG RM-A-007 | | >50 | >50 | >50 | >50 | >50 | 12.584 |
| MG RM-A-008 | | >50 | >50 | >50 | >50 | >50 | 0.303 |
| MG RM-A-009 | | 0.029 | 0.058 | 0.050 | 2.834 | 0.235 | 0.118 |
| MG RM-A-010 | | 0.022 | 0.015 | 0.019 | 2.791 | 0.028 | 0.325 |
| MG RM-A-011 | | >50 | >50 | >50 | >50 | 0.484 | 0.273 |
| MG RM-A-012 | | >50 | >50 | >50 | >50 | 0.230 | >50 |
| MG RM-A-013 | | 9.856 | 3.725 | 9.241 | >50 | 1.761 | 0.152 |
| MG RM-A-014 | | 0.628 | 0.367 | 1.071 | >50 | 1.357 | 0.135 |
| VLGCA1 | | 2.067 | 2.754 | 17.389 | >50 | 8.009 | 0.163 |
| 94 KE 105 | AC | 0.204 | 0.190 | 0.368 | 0.290 | 1.317 | 0.499 |
| 92TH021 | AE | 0.001 | 0.002 | 0.003 | 0.052 | 0.013 | 0.616 |
| CMU02 | | >50 | >50 | >50 | >50 | 1.425 | 0.515 |
| MGRM-AE-001 | | >50 | >50 | >50 | >50 | 20.916 | 0.167 |
| MGRM-AE-002 | | >50 | >50 | >50 | >50 | 1.868 | 0.217 |
| MGRM-AE-003 | | >50 | >50 | >50 | >50 | 0.552 | 0.685 |
| MGRM-AE-004 | | 0.001 | 0.001 | 0.002 | 0.104 | 0.006 | 0.187 |
| MGRM-AE-005 | | >50 | >50 | >50 | >50 | 0.967 | 0.029 |
| MGRM-AE-006 | | >50 | >50 | >50 | >50 | >50 | 4.648 |
| MGRM-AE-007 | | 33.133 | 6.697 | 13.558 | >50 | 0.181 | 0.835 |
| MGRM-AE-008 | | 0.101 | 0.080 | 0.135 | 3.553 | 1.464 | 1.715 |
| MG RM-AG-001 | AG | 18.030 | 12.423 | 18.933 | >50 | 0.164 | 0.228 |
| MG RM-AG-002 | | 0.049 | 0.044 | 0.076 | 7.780 | 0.056 | 0.950 |
| MG RM-AG-003 | | >50 | >50 | >50 | >50 | >50 | 0.043 |
| MG RM-AG-005 | | 0.497 | 0.383 | 1.114 | >50 | 0.045 | 0.091 |
| MG RM-AG-006 | | >50 | >50 | >50 | >50 | 6.603 | 0.344 |
| MG RM-AG-008 | | 19.242 | 12.125 | 34.009 | >50 | 0.244 | 0.124 |
| MG RM-AG-009 | | >50 | >50 | >50 | >50 | >50 | >50 |
| MG RM-AG-011 | | 0.118 | 0.081 | 0.156 | 44.563 | 0.003 | 0.084 |
| MG RM-AG-012 | | >50 | >50 | >50 | >50 | >50 | 0.031 |
| MG RM-AG-013 | | >50 | 21.719 | >50 | >50 | 14.387 | 0.197 |

| | IC$_{50}$ (µg/mL)$^a$ | | IC$_{50}$ (1/dil'n)$^b$ | | | |
|---|---|---|---|---|---|---|
| Isolate | PGV04 | PG9 | #17 | #84 | #36 | #39 |
| 92RW008 | 0.014 | 0.006 | 6500.7 | 9301.5 | 2084.1 | 644.0 |
| 92WR009 | 0.108 | 0.050 | 463.6 | 1247.6 | 241.0 | <100 |
| 92WR020 | 0.055 | 0.141 | 5671.1 | 428.3 | 2617.1 | 2730.0 |
| 92WR021 | 0.038 | 0.027 | 2343.6 | 1092.2 | 4204.8 | 428.0 |
| 92WR024 | 0.310 | 0.258 | <100 | 507.7 | 149.7 | 178.0 |
| 92WR026 | 0.140 | 0.164 | 1561.0 | 717.3 | 2183.4 | 1046.0 |
| 92UG031 | 4.463 | 3.605 | <100 | 282.5 | 422.2 | 459.0 |
| 92UG037 | 0.145 | 0.014 | 1120.4 | 501.8 | 1431.8 | 410.0 |
| 93WR029 | 0.540 | 0.690 | <100 | 589.2 | <100 | 270.0 |
| 93UG077 | 0.083 | >50 | 1082.8 | 326.4 | 707.2 | 436.0 |
| 94UG103 | 0.202 | 0.340 | 193.4 | 208.3 | 1138.4 | 568.0 |
| MG RM-A-001 | 6.781 | >50 | <100 | 231.7 | <100 | 149.0 |
| MG RM-A-002 | 0.093 | 0.020 | 839.3 | 533.0 | 2782.2 | 264.0 |

TABLE 58B-continued

|   |   |   |   |   |   |   |
|---|---|---|---|---|---|---|
| MG RM-A-003 | 0.128 | 1.942 | <100 | 612.2 | <100 | 375.0 |
| MG RM-A-004 | 0.175 | 0.020 | <100 | 4567.2 | <100 | 319.0 |
| MG RM-A-005 | 0.134 | 0.750 | <100 | 151.2 | <100 | 282.0 |
| MG RM-A-006 | 0.244 | <50 | 260.6 | 646.5 | 120.0 | 564.0 |
| MG RM-A-007 | 7.213 | 1.061 | <100 | <100 | <100 | 556.0 |
| MG RM-A-008 | 0.555 | <50 | <100 | <100 | <100 | 196.0 |
| MG RM-A-009 | 0.033 | 0.023 | 4535.8 | 2228.7 | 1611.4 | 286.0 |
| MG RM-A-010 | 0.205 | 0.022 | 271.3 | 1704.2 | 2779.2 | 279.0 |
| MG RM-A-011 | 0.090 | 0.033 | <100 | 242.3 | <100 | 169.0 |
| MG RM-A-012 | 0.225 | 19.294 | 229.9 | <100 | 270.6 | 215.0 |
| MG RM-A-013 | 0.086 | 0.122 | 892.0 | 162.8 | 835.9 | 776.0 |
| MG RM-A-014 | 0.172 | 1.248 | 7222.6 | 412.6 | 705.2 | 681.0 |
| VLGCA1 | 0.024 | 0.069 | <100 | 311.2 | 203.2 | <100 |
| 94 KE 105 | 2.981 | 37.875 | 955.0 | 1035.2 | 4540.1 | 1633.0 |
| 92TH021 | 1.289 | 0.059 | <100 | 5298.1 | 3301.2 | 212.0 |
| CMU02 | 1.238 | >50 | <100 | 101.3 | <100 | 312.0 |
| MGRM-AE-001 | 0.063 | 20.586 | <100 | <100 | 222.6 | 223.0 |
| MGRM-AE-002 | 0.569 | 0.040 | <100 | 169.1 | 254.0 | 249.0 |
| MGRM-AE-003 | 6.401 | 0.044 | <100 | 150.0 | <100 | 181.0 |
| MGRM-AE-004 | 0.183 | 0.009 | <100 | 6926.5 | 131.7 | 123.0 |
| MGRM-AE-005 | 0.051 | 0.282 | <100 | 208.2 | 2772.2 | 265.0 |
| MGRM-AE-006 | >50 | 0.063 | <100 | 117.5 | 1352.7 | 194.0 |
| MGRM-AE-007 | 5.753 | 0.180 | <100 | 270.9 | 444.5 | 184.0 |
| MGRM-AE-008 | 1.513 | 31.482 | <100 | 611.7 | <100 | 341.0 |
| MG RM-AG-001 | 0.218 | 17.125 | 174.8 | 292.1 | 302.2 | 499.0 |
| MG RM-AG-002 | 0.879 | 0.076 | 125.5 | 748.0 | 139.4 | 206.0 |
| MG RM-AG-003 | 0.058 | >50 | <100 | 505.3 | <100 | 121.0 |
| MG RM-AG-005 | 0.027 | >50 | 517.3 | 775.6 | 865.9 | 708.0 |
| MG RM-AG-006 | 1.230 | >50 | 1105.3 | 321.1 | 4106.0 | 536.0 |
| MG RM-AG-008 | 2.484 | 0.013 | 125.1 | 827.8 | <100 | 692.0 |
| MG RM-AG-009 | 0.148 | >50 | 525.2 | 101.4 | 220.2 | 128.0 |
| MG RM-AG-011 | 0.071 | 0.007 | <100 | 2785.8 | 228.1 | 274.0 |
| MG RM-AG-012 | 0.040 | 22.845 | 104.9 | <100 | 136.6 | 235.0 |
| MG RM-AG-013 | 0.030 | 0.259 | 321.2 | 319.1 | 2055.6 | 303.0 |

TABLE 58C

| | | IC$_{50}$ (µg/mL)$^a$ | | | | | |
|---|---|---|---|---|---|---|---|
| Isolate | Subtype | PGT-121 | PGT-122 | PGT-123 | PGT-125 | PGT-126 | PGT-127 |
| 6535.3 | B | 0.005 | 0.006 | 0.004 | 0.010 | 0.022 | 0.020 |
| 92 BR 020 | | 0.014 | 0.021 | 0.008 | 0.016 | 0.015 | 0.059 |
| 93TH305 | | 0.007 | 0.013 | 0.008 | 0.008 | 0.013 | 0.017 |
| APV_13 | | 0.251 | 0.778 | 0.138 | 0.007 | 0.012 | 0.026 |
| APV_17 | | 0.066 | 0.250 | 0.114 | 8.063 | 0.353 | 10.378 |
| APV_6 | | 0.018 | 0.019 | 0.023 | 0.021 | 0.007 | 0.040 |
| CAAN.A2 | | 0.011 | 0.011 | 0.015 | 5.467 | 0.273 | 0.371 |
| JRFL | | 0.021 | 0.026 | 0.014 | 0.009 | 0.014 | 0.029 |
| MGRM-Chronic-B-001 | | 0.102 | 0.138 | 0.150 | >50 | >50 | >50 |
| MGRM-Chronic-B-002 | | 0.386 | 1.801 | 0.234 | 0.064 | 0.078 | 0.279 |
| MGRM-Chronic-B-003 | | 0.011 | 0.008 | 0.008 | 0.157 | 0.041 | 0.120 |
| MGRM-Chronic-B-004 | | 0.009 | 0.008 | 0.008 | 0.007 | 0.010 | 0.018 |
| MGRM-Chronic-B-008 | | 0.007 | 0.017 | 0.010 | >50 | 5.890 | 21.515 |
| MGRM-Chronic-B-010 | | 0.014 | 0.018 | 0.009 | 0.006 | 0.005 | 0.019 |
| MGRM-Chronic-B-011 | | >50 | >50 | >50 | 3.228 | 0.108 | 0.297 |
| MGRM-Chronic-B-012 | | 0.036 | 0.066 | 0.227 | 0.036 | 0.027 | 0.075 |
| MGRM-Chronic-B-017 | | >50 | 5.664 | >50 | >50 | >50 | >50 |
| MGRM-Chronic-B-018 | | >50 | >50 | >50 | >50 | 0.052 | 1.896 |
| MGRM-Chronic-B-020 | | 0.004 | 0.005 | 0.005 | 0.087 | 0.021 | 0.050 |
| MGRM-Chronic-B-023 | | 0.005 | 0.010 | 0.055 | >50 | >50 | >50 |
| MGRM-Chronic-B-024 | | 0.195 | 2.308 | >50 | >50 | >50 | >50 |
| PVO.4 | | 0.137 | 0.689 | 0.105 | 0.042 | 0.017 | 0.164 |
| QH0692.42 | | 0.823 | 0.493 | 0.158 | 0.048 | 0.048 | 0.129 |
| SC422661.8 | | 0.098 | 0.103 | 0.039 | 30.138 | 0.119 | 36.688 |
| SF162 | | 0.005 | 0.009 | 0.005 | 0.004 | 0.003 | 0.019 |
| THR0.18 | | >50 | >50 | >50 | >50 | >50 | >50 |
| TRJ04551.58 | | 7.095 | >50 | 16.913 | 0.019 | 0.025 | 0.063 |
| TRO.11 | | 0.008 | 0.011 | 0.008 | 0.111 | 0.041 | 0.079 |
| VLGCB3 | | 0.005 | 0.008 | 0.004 | 0.015 | 0.007 | 0.022 |
| NL43 | | >50 | >50 | >50 | >50 | >50 | >50 |
| JRCSF | | 0.027 | 0.057 | 0.046 | 0.004 | 0.008 | 0.018 |
| 93IN905 | C | 0.005 | 0.013 | 0.004 | 0.009 | 0.015 | 0.024 |
| 93MW959 | | 0.013 | 0.016 | 0.011 | 37.481 | 9.441 | 6.951 |
| 97ZA012 | | 0.002 | 0.004 | 0.002 | 2.465 | 0.042 | >50 |
| 98IN022 | | 0.007 | 0.032 | 0.011 | 22.057 | 0.279 | 19.189 |
| MG RM-C-001 | | 17.482 | 19.103 | 42.406 | >50 | >50 | >50 |

TABLE 58C-continued

| Isolate | | | | | | |
|---|---|---|---|---|---|---|
| MG RM-C-002 | 0.019 | 0.022 | 0.010 | 0.008 | 0.011 | 0.057 |
| MG RM-C-004 | 0.011 | 0.020 | 0.009 | 1.825 | 0.033 | 0.532 |
| MG RM-C-005 | 0.015 | 0.027 | 0.012 | 2.087 | 0.298 | 0.570 |
| MG RM-C-006 | 0.017 | 0.018 | 0.021 | 0.015 | 0.014 | 0.319 |
| MG RM-C-007 | 0.196 | 3.348 | 0.547 | >50 | 25.298 | >50 |
| MG RM-C-008 | 0.012 | 0.028 | 0.011 | >50 | 2.118 | >50 |
| MG RM-C-009 | >50 | >50 | >50 | >50 | >50 | >50 |
| MG RM-C-010 | >50 | >50 | >50 | >50 | >50 | >50 |
| MG RM-C-012 | 0.123 | 2.002 | 0.606 | >50 | 0.111 | 1.073 |
| MG RM-C-013 | 7.228 | 32.575 | 14.879 | >50 | >50 | >50 |
| MG RM-C-014 | 26.941 | >50 | 1.003 | >50 | >50 | >50 |
| MG RM-C-015 | 25.071 | >50 | 13.141 | >50 | 3.140 | >50 |
| MG RM-C-017 | 0.009 | 0.015 | 0.010 | 2.358 | 0.170 | 3.397 |
| MG RM-C-019 | >50 | 0>50 | >50 | 0.130 | 0.006 | 0.017 |
| MG RM-C-020 | >50 | 13.955 | >50 | >50 | >50 | >50 |
| MG RM-C-022 | 0.015 | 0.012 | 0.010 | 1.233 | 0.960 | 0.410 |
| MG RM-C-023 | 0.017 | 0.027 | 0.011 | 1.314 | 0.065 | 1.082 |
| MG RM-C-024 | 0.052 | 0.102 | 0.195 | >50 | >50 | 1.008 |
| MG RM-C-025 | 46.753 | 8.691 | 13.304 | 42.541 | 0.786 | >50 |
| MG RM-C-026 | 0.002 | 0.006 | 0.001 | 0.005 | 0.007 | 0.014 |
| MG RM-C-027 | 0.011 | 0.039 | 0.020 | >50 | 15.557 | >50 |
| MG RM-C-028 | 0.472 | 2.216 | 0.402 | 14.023 | 0.196 | 7.567 |

| Isolate | IC$_{50}$ (µg/mL)$^a$ | | | | | |
|---|---|---|---|---|---|---|
| | PGT-128 | PGT-130 | PGT-131 | PGT-135 | PGT-136 | PGT-137 |
| 6535.3 | 0.011 | 0.031 | 0.056 | >50 | >50 | >50 |
| 92 BR 020 | 0.009 | 1.395 | 6.157 | 0.073 | 8.608 | 7.811 |
| 93TH305 | 0.006 | 0.021 | 0.016 | >50 | 20.214 | >50 |
| APV_13 | 0.008 | 0.052 | 0.189 | 0.716 | >50 | >50 |
| APV_17 | 0.016 | 10.661 | >50 | >50 | >50 | >50 |
| APV_6 | 0.007 | >50 | >50 | >50 | >50 | >50 |
| CAAN.A2 | 1.482 | >50 | >50 | 5.154 | >50 | >50 |
| JRFL | 0.007 | 0.046 | 0.454 | >50 | >50 | >50 |
| MGRM-Chronic-B-001 | >50 | >50 | >50 | >50 | >50 | >50 |
| MGRM-Chronic-B-002 | 0.036 | >50 | >50 | >50 | >50 | >50 |
| MGRM-Chronic-B-003 | 0.007 | >50 | >50 | >50 | >50 | >50 |
| MGRM-Chronic-B-004 | 0.009 | 0.010 | 0.040 | >50 | >50 | >50 |
| MGRM-Chronic-B-008 | 0.143 | 5.183 | >50 | >50 | >50 | >50 |
| MGRM-Chronic-B-010 | 0.004 | 0.006 | 0.016 | >50 | >50 | >50 |
| MGRM-Chronic-B-011 | 0.020 | 0.153 | 6.468 | >50 | >50 | >50 |
| MGRM-Chronic-B-012 | 0.026 | 0.373 | 15.708 | 0.166 | 43.142 | >50 |
| MGRM-Chronic-B-017 | >50 | >50 | >50 | >50 | >50 | >50 |
| MGRM-Chronic-B-018 | 0.020 | 31.873 | >50 | >50 | >50 | >50 |
| MGRM-Chronic-B-020 | 0.007 | 0.014 | 0.053 | 0.057 | >50 | 32.851 |
| MGRM-Chronic-B-023 | >50 | >50 | >50 | 0.329 | >50 | >50 |
| MGRM-Chronic-B-024 | >50 | 5.776 | >50 | >50 | >50 | >50 |
| PVO.4 | 0.005 | 5.171 | >50 | >50 | >50 | >50 |
| QH0692.42 | 0.029 | >50 | >50 | >50 | >50 | >50 |
| SC422661.8 | 1.578 | >50 | >50 | 21.751 | >50 | >50 |
| SF162 | 0.007 | 0.007 | 0.025 | 0.023 | 0.482 | 3.407 |
| THR0.18 | >50 | >50 | >50 | >50 | >50 | >50 |
| TRJ04551.58 | 0.019 | 0.023 | 0.088 | >50 | >50 | >50 |
| TRO.11 | 0.018 | 0.257 | 1.913 | 0.030 | 0.073 | 9.349 |
| VLGCB3 | 0.012 | 4.596 | >50 | 0.142 | >50 | 3.361 |
| NL43 | >50 | >50 | >50 | 8.034 | 27.695 | 17.444 |
| JRCSF | 0.003 | 0.010 | 0.029 | 0.131 | >50 | >50 |
| 93IN905 | 0.009 | 0.020 | 0.177 | 0.011 | 0.011 | 0.042 |
| 93MW959 | 0.045 | 8.548 | >50 | >50 | >50 | >50 |
| 97ZA012 | 0.019 | 1.318 | 1.814 | >50 | >50 | >50 |
| 98IN022 | 0.014 | >50 | >50 | 0.014 | 13.622 | 0.408 |
| MG RM-C-001 | >50 | >50 | >50 | 10.121 | 7.518 | 21.503 |
| MG RM-C-002 | 0.019 | >50 | >50 | >50 | >50 | 8.034 |
| MG RM-C-004 | 0.025 | 2.756 | 3.714 | 0.046 | 0.034 | 0.026 |
| MG RM-C-005 | 0.030 | 0.935 | 1.356 | >50 | >50 | >50 |
| MG RM-C-006 | 0.014 | 0.095 | 0.611 | >50 | >50 | >50 |
| MG RM-C-007 | 0.111 | >50 | >50 | >50 | >50 | >50 |
| MG RM-C-008 | 0.373 | 7.277 | >50 | >50 | >50 | >50 |
| MG RM-C-009 | >50 | >50 | >50 | >50 | >50 | >50 |
| MG RM-C-010 | >50 | >50 | >50 | >50 | >50 | >50 |
| MG RM-C-012 | 0.058 | >50 | >50 | 0.017 | >50 | 0.102 |
| MG RM-C-013 | >50 | >50 | >50 | >50 | >50 | >50 |
| MG RM-C-014 | >50 | >50 | >50 | >50 | >50 | >50 |
| MG RM-C-015 | 0.196 | 0.344 | 1.015 | 0.104 | 11.066 | 1.983 |
| MG RM-C-017 | 1.065 | >50 | >50 | >50 | >50 | >50 |
| MG RM-C-019 | 0.010 | 0.010 | 0.021 | 0.264 | 20.100 | >50 |
| MG RM-C-020 | 5.846 | >50 | >50 | >50 | >50 | >50 |
| MG RM-C-022 | 0.042 | 0.127 | 0.780 | >50 | >50 | >50 |
| MG RM-C-023 | 0.026 | 0.151 | 0.143 | 0.061 | 3.198 | 0.230 |

TABLE 58C-continued

| | | | | | | |
|---|---|---|---|---|---|---|
| MG RM-C-024 | >50 | >50 | >50 | >50 | >50 | >50 |
| MG RM-C-025 | 10.489 | >50 | >50 | >50 | >50 | >50 |
| MG RM-C-026 | 0.007 | 0.036 | 1.674 | 0.004 | 0.006 | 0.011 |
| MG RM-C-027 | 0.081 | 0.008 | 0.065 | >50 | >50 | >50 |
| MG RM-C-028 | 14.423 | >50 | >50 | 1.474 | 33.676 | >50 |

| | | IC$_{50}$ (µg/mL)$^a$ | | | | | |
|---|---|---|---|---|---|---|---|
| Isolate | Subtype | PGT-141 | PGT-142 | PGT-143 | PGT-144 | PGT-145 | VRC01 |
| 6535.3 | B | >50 | >50 | >50 | >50 | >50 | 1.755 |
| 92 BR 020 | | 20.299 | 15.146 | 25.892 | 44.036 | 1.051 | 0.290 |
| 93TH305 | | >50 | 5.856 | 17.270 | >50 | 0.032 | 0.243 |
| APV_13 | | >50 | >50 | >50 | >50 | 0.337 | 0.657 |
| APV_17 | | 0.590 | 0.628 | 1.108 | 10.298 | 0.488 | 0.477 |
| APV_6 | | 14.216 | 4.725 | 13.968 | >50 | 0.104 | 1.812 |
| CAAN.A2 | | >50 | >50 | >50 | >50 | 7.085 | 0.722 |
| JRFL | | >50 | >50 | >50 | >50 | 30.401 | 0.034 |
| MGRM-Chronic-B-001 | | >50 | >50 | >50 | >50 | 3.223 | 0.066 |
| MGRM-Chronic-B-002 | | >50 | >50 | >50 | >50 | 3.672 | 0.117 |
| MGRM-Chronic-B-003 | | 0.400 | 0.484 | 0.854 | 7.408 | 0.045 | 0.100 |
| MGRM-Chronic-B-004 | | 0.586 | 0.172 | 0.395 | 9.415 | 0.023 | 0.055 |
| MGRM-Chronic-B-008 | | >50 | >50 | >50 | >50 | 1.903 | 0.155 |
| MGRM-Chronic-B-010 | | >50 | >50 | >50 | >50 | >50 | 0.156 |
| MGRM-Chronic-B-011 | | 2.241 | 0.994 | 1.557 | 5.637 | 0.206 | 0.587 |
| MGRM-Chronic-B-012 | | >50 | >50 | >50 | >50 | 9.062 | 1.033 |
| MGRM-Chronic-B-017 | | 0.147 | 0.076 | 0.145 | 0.712 | 0.054 | 0.141 |
| MGRM-Chronic-B-018 | | 0.572 | 0.323 | 0.377 | 2.397 | 0.013 | 0.328 |
| MGRM-Chronic-B-020 | | >50 | >50 | >50 | >50 | >50 | 0.424 |
| MGRM-Chronic-B-023 | | 0.318 | 0.486 | 0.236 | >50 | 0.009 | 0.275 |
| MGRM-Chronic-B-024 | | 0.011 | 0.005 | 0.010 | 0.040 | 0.018 | 0.377 |
| PVO.4 | | 0.113 | 0.066 | 0.162 | 0.535 | 0.299 | 0.218 |
| QH0692.42 | | >50 | >50 | >50 | >50 | >50 | 1.194 |
| SC422661.8 | | 1.656 | 3.153 | 2.017 | >50 | 0.079 | 0.179 |
| SF162 | | >50 | >50 | >50 | >50 | >50 | 0.421 |
| THR0.18 | | 0.007 | 0.012 | 0.016 | 0.029 | 0.013 | 2.461 |
| TRJ04551.58 | | >50 | >50 | >50 | >50 | >50 | 0.060 |
| TRO.11 | | 0.383 | 0.270 | 0.219 | 4.728 | 0.044 | 0.186 |
| VLGCB3 | | >50 | >50 | >50 | >50 | >50 | 0.108 |
| NL43 | | >50 | >50 | >50 | >50 | 0.006 | 0.100 |
| JRCSF | | 0.009 | 0.010 | 0.007 | 0.149 | 0.002 | 0.164 |
| 93IN905 | C | 0.001 | 0.001 | 0.002 | 0.132 | 0.002 | 0.138 |
| 93MW959 | | 0.003 | 0.001 | 0.002 | 0.332 | 1.203 | 0.053 |
| 97ZA012 | | >50 | >50 | >50 | >50 | 0.915 | 0.088 |
| 98IN022 | | 0.001 | 0.001 | 0.001 | 0.171 | 0.005 | 0.342 |
| MG RM-C-001 | | >50 | >50 | >50 | >50 | >50 | 1.369 |
| MG RM-C-002 | | 7.834 | 10.535 | 6.766 | >50 | 0.008 | 0.577 |
| MG RM-C-004 | | >50 | >50 | >50 | >50 | >50 | 1.007 |
| MG RM-C-005 | | 8.832 | 1.854 | 9.192 | >50 | >50 | 5.417 |
| MG RM-C-006 | | 0.330 | 0.478 | 0.369 | 48.894 | 0.010 | 2.202 |
| MG RM-C-007 | | >50 | >50 | >50 | >50 | >50 | >50 |
| MG RM-C-008 | | >50 | >50 | >50 | >50 | >50 | 1.445 |
| MG RM-C-009 | | 0.143 | 0.061 | 0.121 | 0.561 | 0.193 | 0.261 |
| MG RM-C-010 | | 0.411 | 0.070 | 0.171 | 7.616 | 0.141 | 0.085 |
| MG RM-C-012 | | >50 | >50 | >50 | >50 | 6.984 | 0.073 |
| MG RM-C-013 | | >50 | >50 | >50 | >50 | >50 | >50 |
| MG RM-C-014 | | 11.807 | 6.024 | 8.811 | >50 | 5.816 | >50 |
| MG RM-C-015 | | 0.033 | 0.038 | 0.085 | 0.236 | 0.120 | 1.569 |
| MG RM-C-017 | | 4.018 | 1.111 | 5.170 | 23.035 | >50 | 0.366 |
| MG RM-C-019 | | 0.008 | 0.003 | 0.004 | 0.513 | 0.005 | 1.126 |
| MG RM-C-020 | | 1.336 | 0.446 | 0.797 | 1.288 | 0.712 | 0.396 |
| MG RM-C-022 | | 0.381 | 0.086 | 0.103 | 2.578 | 0.492 | 12.989 |
| MG RM-C-023 | | 0.153 | 0.087 | 0.148 | 0.380 | 0.201 | 0.077 |
| MG RM-C-024 | | 0.101 | 0.030 | 0.050 | 2.064 | 0.174 | 3.395 |
| MG RM-C-025 | | 0.247 | 0.183 | 0.336 | 17.550 | 0.044 | 2.364 |
| MG RM-C-026 | | >50 | >50 | >50 | >50 | >50 | 0.707 |
| MG RM-C-027 | | 3.275 | 0.792 | 0.598 | >50 | 0.095 | 0.125 |
| MG RM-C-028 | | 13.771 | 2.117 | 12.367 | >50 | 0.099 | 0.319 |

| | IC$_{50}$ (µg/mL)$^a$ | | IC$_{50}$ (1/dil'n)$^b$ | | | |
|---|---|---|---|---|---|---|
| Isolate | PGV04 | PG9 | #17 | #84 | #36 | #39 |
| 6535.3 | 0.757 | 1.053 | 3712.0 | 477.8 | 848.0 | 387.0 |
| 92 BR 020 | 0.250 | >50 | 1623.7 | 262.2 | 741.3 | 421.0 |
| 93TH305 | 0.255 | 8.124 | 3675.2 | 828.0 | 1520.7 | 306.0 |
| APV_13 | 1.227 | >50 | 177.8 | 211.6 | 1460.1 | 173.0 |
| APV_17 | 0.309 | 34.778 | 470.0 | 161.5 | 279.4 | 482.0 |
| APV_6 | 24.187 | 0.181 | 914.6 | 253.2 | 512.9 | 706.0 |
| CAAN.A2 | 2.262 | 19.267 | 1743.1 | 173.1 | 148.8 | 222.0 |

TABLE 58C-continued

|  | | | | | | |
|---|---|---|---|---|---|---|
| JRFL | 0.032 | >50 | 1291.5 | 348.5 | 858.2 | 471.0 |
| MGRM-Chronic-B-001 | 0.048 | >50 | 330.1 | 160.6 | 246.0 | 390.0 |
| MGRM-Chronic-B-002 | 0.142 | 3.439 | 200.1 | <100 | 344.4 | 320.0 |
| MGRM-Chronic-B-003 | 0.258 | >50 | 3664.9 | 307.2 | 370.4 | 103.0 |
| MGRM-Chronic-B-004 | 0.047 | 0.533 | 1874.9 | 796.5 | 1463.1 | 304.0 |
| MGRM-Chronic-B-008 | 0.166 | 8.784 | 2805.1 | 251.8 | 260.2 | 685.0 |
| MGRM-Chronic-B-010 | 0.744 | 0.004 | 1145.5 | 443.0 | 3234.8 | 383.0 |
| MGRM-Chronic-B-011 | 0.497 | >50 | 130.8 | 458.4 | 1030.2 | 759.0 |
| MGRM-Chronic-B-012 | >50 | 0.200 | 903.5 | 480.6 | 634.2 | 664.0 |
| MGRM-Chronic-B-017 | 0.129 | 0.688 | 132.7 | 317.6 | <100 | 383.0 |
| MGRM-Chronic-B-018 | 0.164 | 0.216 | <100 | 612.7 | 289.3 | 375.0 |
| MGRM-Chronic-B-020 | 1.262 | >50 | 4132.2 | 390.1 | 858.8 | 305.0 |
| MGRM-Chronic-B-023 | 0.139 | 0.027 | 2216.5 | 950.0 | 196.7 | 523.0 |
| MGRM-Chronic-B-024 | 2.517 | 0.222 | 157.1 | 1060.2 | 104.1 | 110.0 |
| PVO.4 | 0.454 | 24.752 | 212.9 | 239.4 | 420.8 | 123.0 |
| QH0692.42 | 1.904 | >50 | 175.1 | <100 | 227.6 | 359.0 |
| SC422661.8 | 0.110 | 1.477 | 367.3 | 228.7 | <100 | 220.0 |
| SF162 | 0.028 | >50 | 5329.3 | 2049.0 | 5103.0 | 3043.0 |
| THR0.18 | >50 | 26.379 | <100 | 1036.0 | 107.7 | 126.0 |
| TRJ04551.58 | 0.028 | 0.858 | 152.5 | 400.2 | 1416.1 | 617.0 |
| TRO.11 | 0.121 | 16.865 | 2706.9 | 861.3 | 454.5 | 2740.0 |
| VLGCB3 | 0.045 | 0.022 | 2961.7 | 238.5 | 1333.0 | 754.0 |
| NL43 | 0.028 | >50 | 418.2 | 3308.8 | 3033.8 | 1184.0 |
| JRCSF | 0.078 | 0.003 | 863.0 | 6255.4 | 2371.1 | 433.0 |
| 93IN905 | 0.332 | 0.035 | 4396.9 | 14817.0 | 1313.8 | 3667.0 |
| 93MW959 | >50 | 0.054 | 1602.2 | 6171.8 | 176.1 | 506.0 |
| 97ZA012 | 0.041 | 3.400 | 8150.0 | 1083.1 | 433.0 | 594.0 |
| 98IN022 | 5.693 | 0.003 | 3711.8 | 15197.1 | 729.6 | 1918.0 |
| MG RM-C-001 | >50 | >50 | <100 | 117.0 | <100 | 174.0 |
| MG RM-C-002 | >50 | >50 | 1799.2 | 733.6 | 704.1 | 556.0 |
| MG RM-C-004 | 0.899 | 2.011 | 2177.9 | 234.5 | 327.9 | 2064.0 |
| MG RM-C-005 | 23.898 | 8.742 | 1323.5 | 405.1 | 383.0 | 600.0 |
| MG RM-C-006 | >50 | 0.427 | 1681.6 | 1231.3 | 532.3 | 564.0 |
| MG RM-C-007 | >50 | 0.064 | 330.7 | 244.2 | <100 | 442.0 |
| MG RM-C-008 | 0.791 | >50 | 1742.3 | 223.3 | <100 | 903.0 |
| MG RM-C-009 | 1.042 | >50 | <100 | 460.9 | <100 | 224.0 |
| MG RM-C-010 | 0.299 | >50 | <100 | 836.6 | <100 | 316.0 |
| MG RM-C-012 | 0.025 | 0.610 | 716.3 | 521.6 | 169.8 | 2150.0 |
| MG RM-C-013 | >50 | >50 | <100 | <100 | <100 | 453.0 |
| MG RM-C-014 | 21.190 | 1.099 | <100 | 702.6 | <100 | <100 |
| MG RM-C-015 | 0.983 | 0.427 | 141.6 | 544.2 | 253.4 | 1095.0 |
| MG RM-C-017 | 0.383 | 2.688 | 3154.6 | 225.7 | 266.4 | 1587.0 |
| MG RM-C-019 | 9.632 | 0.005 | <100 | 4576.4 | 1383.6 | 424.0 |
| MG RM-C-020 | 0.112 | >50 | 110.9 | 245.6 | 115.3 | <100 |
| MG RM-C-022 | 18.283 | 0.346 | 1972.8 | 921.3 | 725.8 | 658.0 |
| MG RM-C-023 | 0.128 | 0.614 | 1046.6 | 354.6 | 285.3 | 1358.0 |
| MG RM-C-024 | >50 | 0.227 | 718.0 | 607.2 | <100 | 170.0 |
| MG RM-C-025 | >50 | 0.148 | 228.2 | 886.0 | 129.6 | 651.0 |
| MG RM-C-026 | 0.303 | 0.060 | 12635.8 | 2201.2 | 2438.1 | 9554.0 |
| MG RM-C-027 | 2.762 | 5.358 | 2368.0 | 859.3 | 1636.4 | 869.0 |
| MG RM-C-028 | 0.149 | 0.067 | 115.0 | 363.0 | <100 | 502.0 |

TABLE 58D

| | | $IC_{50}$ (µg/mL)$^a$ | | | | | |
|---|---|---|---|---|---|---|---|
| Isolate | Subtype | PGT-121 | PGT-122 | PGT-123 | PGT-125 | PGT-126 | PGT-127 |
| 98CN009 | CRF07_BC | 0.009 | 0.013 | 0.007 | 0.030 | 0.019 | 0.090 |
| 98CN006 | CRF08_BC | 0.010 | 0.021 | 0.008 | 0.201 | 0.046 | 0.067 |
| 92UG001 | D | >50 | >50 | >50 | >50 | >50 | >50 |
| 92UG005 | | 18.292 | >50 | 9.794 | >50 | 0.037 | 1.107 |
| 92UG024 | | >50 | >50 | >50 | >50 | >50 | >50 |
| 92UG046 | | >50 | >50 | >50 | >50 | >50 | >50 |
| 92UG114 | | 0.004 | 0.011 | 0.005 | 0.349 | 0.038 | 7.091 |
| MG RM-D-001 | | 0.615 | 1.130 | 0.147 | 2.837 | 0.084 | 2.234 |
| MG RM-D-002 | | 0.006 | 0.005 | 0.012 | 0.118 | 0.039 | 0.600 |
| MG RM-D-003 | | 10.685 | >50 | 3.736 | 0.065 | 0.021 | 0.029 |
| MG RM-D-004 | | >50 | >50 | >50 | 0.371 | >50 | >50 |
| MG RM-D-005 | | >50 | >50 | >50 | >50 | 0.792 | 6.044 |
| MG RM-D-008 | | >50 | >50 | >50 | >50 | 43.139 | >50 |
| MG RM-D-011 | | 0.018 | 0.019 | 0.012 | 0.008 | 0.009 | 0.015 |
| MG RM-D-012 | | >50 | >50 | >50 | >50 | >50 | >50 |
| MG RM-D-013 | | >50 | >50 | >50 | >50 | >50 | >50 |
| MG RM-D-014 | | 0.009 | 0.012 | 0.009 | 0.120 | 0.030 | 0.393 |
| MG RM-D-016 | | >50 | >50 | >50 | >50 | >50 | >50 |
| MG RM-D-018 | | 0.005 | 0.007 | 0.007 | 0.049 | 0.009 | 0.021 |

TABLE 58D-continued

| Isolate | | | | | | |
|---|---|---|---|---|---|---|
| MG RM-D-019 | >50 | >50 | >50 | >50 | >50 | >50 |
| MG RM-D-020 | 0.010 | 0.007 | 0.018 | 0.015 | 0.023 | 0.015 |
| MG RM-D-021 | 5.334 | 11.735 | 11.120 | 0.040 | 0.047 | 0.056 |
| MG RM-D-022 | >50 | >50 | >50 | >50 | >50 | >50 |
| MG RM-D-024 | 0.038 | 0.185 | 0.023 | >50 | 0.376 | 1.945 |
| MG RM-D-026 | >50 | >50 | >50 | >50 | >50 | >50 |
| MG RM-D-028 | 0.009 | 3.338 | 0.132 | >50 | >50 | >50 |
| MG RM-D-029 | >50 | >50 | >50 | >50 | >50 | >50 |
| MGRM-F1-004 F | 1.665 | 1.291 | 1.783 | 0.035 | 0.063 | 0.068 |
| MGRM-F1-006 | 5.328 | 3.266 | 6.894 | 0.361 | 0.078 | 7.172 |
| MGRM-F1-008 | >50 | >50 | >50 | >50 | >50 | >50 |
| MGRM-F1-010 | 0.016 | 0.024 | 0.016 | >50 | >50 | >50 |
| MGRM-F1-012 | 1.907 | >50 | 22.222 | >50 | 0.300 | >50 |
| MGRM-F1-013 | 0.083 | 0.152 | 0.080 | >50 | >50 | >50 |
| MGRM-F1-014 | 0.082 | 0.195 | 0.111 | >50 | >50 | >50 |
| MGRM-F1-015 | 28.359 | 31.437 | >50 | >50 | >50 | >50 |
| MGRM-F1-016 | 0.931 | 4.808 | 4.948 | >50 | >50 | >50 |
| MGRM-F1-017 | 16.891 | >50 | >50 | >50 | >50 | >50 |
| MGRM-F1-018 | 0.040 | 0.563 | 0.054 | >50 | 14.941 | 3.586 |
| MGRM-F1-020 | 0.167 | 0.321 | 0.051 | >50 | >50 | >50 |
| MGRM-F1-021 | 0.099 | 2.301 | 0.307 | >50 | >50 | >50 |
| MGRM-F1-022 | 0.104 | 0.277 | 0.075 | >50 | >50 | >50 |
| MGRM-F1-023 | 0.097 | 0.154 | 0.053 | 0.012 | 0.009 | 0.119 |

| | IC$_{50}$ (μg/mL)$^a$ | | | | | |
|---|---|---|---|---|---|---|
| Isolate | PGT-128 | PGT-130 | PGT-131 | PGT-135 | PGT-136 | PGT-137 |
| 98CN009 | 0.025 | 0.136 | 4.051 | 0.071 | 0.428 | 5.059 |
| 98CN006 | 0.015 | 0.258 | 35.286 | 0.429 | 0.406 | 1.217 |
| 92UG001 | >50 | >50 | >50 | >50 | >50 | >50 |
| 92UG005 | 0.018 | 0.959 | 0.854 | >50 | >50 | >50 |
| 92UG024 | >50 | >50 | >50 | 0.010 | 0.052 | 0.106 |
| 92UG046 | >50 | >50 | >50 | >50 | >50 | >50 |
| 92UG114 | 0.083 | >50 | >50 | 1.289 | >50 | >50 |
| MG RM-D-001 | 0.138 | >50 | >50 | >50 | >50 | >50 |
| MG RM-D-002 | 0.011 | 0.869 | 11.150 | >50 | >50 | >50 |
| MG RM-D-003 | 0.019 | 0.651 | 19.624 | >50 | >50 | >50 |
| MG RM-D-004 | 24.887 | 1.208 | 2.007 | >50 | >50 | >50 |
| MG RM-D-005 | 0.051 | >50 | >50 | >50 | >50 | >50 |
| MG RM-D-008 | 0.033 | >50 | >50 | >50 | >50 | >50 |
| MG RM-D-011 | 0.007 | 0.019 | 0.756 | 23.478 | >50 | 6.297 |
| MG RM-D-012 | >50 | >50 | >50 | >50 | >50 | >50 |
| MG RM-D-013 | 8.847 | 0.429 | 4.141 | >50 | >50 | >50 |
| MG RM-D-014 | 0.013 | 0.061 | 0.516 | 2.209 | >50 | >50 |
| MG RM-D-016 | >50 | >50 | >50 | >50 | >50 | >50 |
| MG RM-D-018 | 0.008 | 0.049 | 0.148 | 0.039 | >50 | 15.100 |
| MG RM-D-019 | >50 | >50 | >50 | >50 | >50 | >50 |
| MG RM-D-020 | 0.011 | 24.677 | >50 | >50 | >50 | >50 |
| MG RM-D-021 | 0.014 | 0.156 | 0.106 | >50 | >50 | >50 |
| MG RM-D-022 | >50 | >50 | >50 | >50 | >50 | >50 |
| MG RM-D-024 | 0.067 | >50 | >50 | >50 | >50 | >50 |
| MG RM-D-026 | >50 | >50 | >50 | >50 | >50 | >50 |
| MG RM-D-028 | >50 | 0.825 | >50 | >50 | >50 | >50 |
| MG RM-D-029 | >50 | >50 | >50 | 30.849 | >50 | >50 |
| MGRM-F1-004 | 0.027 | 0.023 | 0.114 | 0.211 | >50 | 40.343 |
| MGRM-F1-006 | 0.763 | >50 | >50 | >50 | >50 | >50 |
| MGRM-F1-008 | >50 | 0.065 | 2.742 | >50 | >50 | >50 |
| MGRM-F1-010 | 16.663 | >50 | >50 | >50 | >50 | >50 |
| MGRM-F1-012 | 0.007 | >50 | >50 | 0.010 | >50 | >50 |
| MGRM-F1-013 | 12.723 | >50 | >50 | 21.080 | >50 | >50 |
| MGRM-F1-014 | 0.277 | 11.795 | >50 | >50 | >50 | >50 |
| MGRM-F1-015 | >50 | >50 | >50 | 1.114 | >50 | >50 |
| MGRM-F1-016 | 1.209 | >50 | >50 | >50 | >50 | >50 |
| MGRM-F1-017 | 11.659 | >50 | >50 | 7.788 | >50 | >50 |
| MGRM-F1-018 | 0.023 | >50 | >50 | >50 | >50 | >50 |
| MGRM-F1-020 | 0.355 | 9.728 | >50 | 0.168 | 9.311 | 1.931 |
| MGRM-F1-021 | >50 | >50 | >50 | 0.065 | >50 | >50 |
| MGRM-F1-022 | 4.545 | >50 | >50 | 0.964 | 2.418 | 6.231 |
| MGRM-F1-023 | 0.007 | 0.050 | >50 | 0.088 | >50 | >50 |

| | | IC$_{50}$ (μg/mL)$^a$ | | | | |
|---|---|---|---|---|---|---|
| Isolate | Subtype | PGT-141 | PGT-142 | PGT-143 | PGT-144 | PGT-145 | VRC01 |
| 98CN009 | CRF07_BC | 1.277 | 3.999 | 10.206 | >50 | 0.136 | 0.346 |
| 98CN006 | CRF08_BC | >50 | >50 | >50 | >50 | >50 | 0.644 |
| 92UG001 | D | >50 | >50 | >50 | >50 | >50 | 1.159 |
| 92UG005 | | >50 | >50 | >50 | >50 | >50 | 0.576 |
| 92UG024 | | >50 | >50 | >50 | >50 | 1.600 | 0.576 |

TABLE 58D-continued

| | | | | | | |
|---|---|---|---|---|---|---|
| 92UG046 | >50 | >50 | >50 | >50 | >50 | 12.687 |
| 92UG114 | >50 | >50 | >50 | >50 | 20.113 | 0.330 |
| MG RM-D-001 | >50 | >50 | >50 | >50 | 0.560 | >50 |
| MG RM-D-002 | >50 | >50 | >50 | >50 | >50 | 0.252 |
| MG RM-D-003 | >50 | >50 | >50 | >50 | 0.006 | 2.064 |
| MG RM-D-004 | >50 | >50 | >50 | >50 | 10.881 | 1.250 |
| MG RM-D-005 | 5.154 | 1.153 | 1.414 | 14.807 | 10.398 | >50 |
| MG RM-D-008 | 0.371 | 0.174 | 0.153 | 9.849 | 0.025 | 0.854 |
| MG RM-D-011 | >50 | >50 | >50 | >50 | 14.655 | 0.075 |
| MG RM-D-012 | >50 | >50 | >50 | >50 | >50 | 0.216 |
| MG RM-D-013 | 0.179 | 0.221 | 0.386 | >50 | 3.480 | 0.087 |
| MG RM-D-014 | 0.010 | 0.005 | 0.009 | 0.113 | 2.511 | 0.332 |
| MG RM-D-016 | >50 | >50 | >50 | >50 | >50 | 0.452 |
| MG RM-D-018 | >50 | >50 | >50 | >50 | 0.065 | >50 |
| MG RM-D-019 | 1.655 | 0.155 | 0.277 | >50 | 0.111 | 0.119 |
| MG RM-D-020 | >50 | >50 | >50 | >50 | 10.003 | 0.192 |
| MG RM-D-021 | >50 | >50 | >50 | >50 | >50 | 33.445 |
| MG RM-D-022 | >50 | >50 | >50 | >50 | 34.305 | >50 |
| MG RM-D-024 | >50 | >50 | >50 | >50 | 0.224 | 0.366 |
| MG RM-D-026 | 32.480 | 12.512 | 44.566 | >50 | 0.410 | 0.435 |
| MG RM-D-028 | >50 | >50 | >50 | >50 | 0.721 | 0.377 |
| MG RM-D-029 | 0.057 | 0.192 | 0.200 | 0.459 | 0.030 | 3.224 |
| MGRM-F1-004  F | 0.021 | 0.013 | 0.036 | 0.105 | 0.361 | 0.305 |
| MGRM-F1-006 | 8.993 | 12.874 | 12.341 | 20.563 | 13.642 | 2.856 |
| MGRM-F1-008 | 0.193 | 0.124 | 0.189 | 0.507 | 0.228 | 1.114 |
| MGRM-F1-010 | >50 | >50 | >50 | >50 | 3.321 | 0.097 |
| MGRM-F1-012 | >50 | >50 | >50 | >50 | 0.113 | 0.488 |
| MGRM-F1-013 | 0.043 | 0.023 | 0.013 | 0.509 | 0.402 | 0.170 |
| MGRM-F1-014 | 0.001 | 0.001 | 0.001 | 0.014 | 0.009 | 0.056 |
| MGRM-F1-015 | >50 | >50 | >50 | >50 | 1.764 | 0.387 |
| MGRM-F1-016 | >50 | >50 | >50 | >50 | 17.531 | 0.517 |
| MGRM-F1-017 | 30.829 | 23.465 | 26.279 | >50 | 0.286 | 1.077 |
| MGRM-F1-018 | 0.785 | 0.404 | 0.701 | >50 | 1.020 | 0.032 |
| MGRM-F1-020 | 1.152 | 0.824 | 0.980 | 8.929 | 0.816 | 1.890 |
| MGRM-F1-021 | >50 | >50 | >50 | >50 | 8.038 | 0.039 |
| MGRM-F1-022 | 0.114 | 0.040 | 0.082 | 0.382 | 0.009 | 0.055 |
| MGRM-F1-023 | 0.307 | 0.602 | 0.972 | 1.163 | 5.879 | 0.392 |

| | IC$_{50}$ (µg/mL)$^a$ | | IC$_{50}$ (1/dil'n)$^b$ | | | |
|---|---|---|---|---|---|---|
| Isolate | PGV04 | PG9 | #17 | #84 | #36 | #39 |
| 98CN009 | 0.0125 | 0.371 | 2551.0 | 1469.5 | 756.3 | 1430.0 |
| 98CN006 | 1.320 | >50 | 1908.7 | 365.2 | 367.0 | 980.0 |
| 92UG001 | 0.553 | >50 | <100 | <100 | <100 | 260.0 |
| 92UG005 | 0.440 | >50 | 265.5 | <100 | 590.3 | 480.0 |
| 92UG024 | 0.201 | 1.861 | <100 | 202.0 | 138.1 | 1930.0 |
| 92UG046 | 22.362 | 1.861 | <100 | 200.5 | <100 | 137.0 |
| 92UG114 | 0.461 | 40.608 | 5390.2 | <100 | 292.1 | 548.0 |
| MG RM-D-001 | >50 | >50 | <100 | <100 | 112.8 | <100 |
| MG RM-D-002 | 0.322 | 0.021 | 5960.5 | <100 | 726.4 | 442.0 |
| MG RM-D-003 | >50 | 0.033 | 183.1 | 695.8 | 414.7 | 176.0 |
| MG RM-D-004 | 43.200 | 0.060 | <100 | 125.9 | 108.5 | 397.0 |
| MG RM-D-005 | >50 | 1.802 | <100 | 235.9 | 109.3 | 249.0 |
| MG RM-D-008 | 3.564 | 11.454 | <100 | 348.8 | <100 | 356.0 |
| MG RM-D-011 | 0.025 | 0.071 | 1037.5 | 123.2 | 769.0 | 498.0 |
| MG RM-D-012 | 0.125 | 16.182 | <100 | 109.0 | 109.1 | 261.0 |
| MG RM-D-013 | 0.088 | 0.021 | <100 | 745.4 | 422.8 | 377.0 |
| MG RM-D-014 | 0.194 | 0.023 | 2249.9 | 1526.5 | 428.0 | 322.0 |
| MG RM-D-016 | 0.201 | 0.098 | <100 | 282.7 | 203.4 | 253.0 |
| MG RM-D-018 | 17.528 | 0.025 | 6632.6 | 259.2 | 1730.4 | 642.0 |
| MG RM-D-019 | 0.350 | 0.038 | <100 | 296.7 | 260.0 | 467.0 |
| MG RM-D-020 | 0.097 | 1.665 | 2488.0 | <100 | 393.5 | 190.0 |
| MG RM-D-021 | >50 | >50 | <100 | <100 | 457.5 | 148.0 |
| MG RM-D-022 | >50 | >50 | <100 | <100 | <100 | <100 |
| MG RM-D-024 | >50 | 0.038 | 355.3 | 144.4 | 124.7 | 399.0 |
| MG RM-D-026 | 1.761 | 23.664 | <100 | 401.4 | 103.2 | <100 |
| MG RM-D-028 | 1.008 | 20.234 | 2028.2 | 259.0 | <100 | 563.0 |
| MG RM-D-029 | 1.557 | >50 | <100 | 291.4 | <100 | 387.0 |
| MGRM-F1-004 | 0.580 | 0.175 | 260.7 | 874.0 | 687.6 | 366.0 |
| MGRM-F1-006 | >50 | 7.249 | <100 | 147.3 | 110.8 | 487.0 |
| MGRM-F1-008 | 1.031 | >50 | <100 | 242.1 | <100 | 308.0 |
| MGRM-F1-010 | 0.184 | 0.012 | 825.3 | 420.4 | <100 | 564.0 |
| MGRM-F1-012 | 0.250 | 0.023 | 573.3 | 332.3 | 299.8 | 1366.0 |
| MGRM-F1-013 | 0.084 | 1.253 | 283.9 | 2403.4 | 377.4 | 625.0 |
| MGRM-F1-014 | 0.020 | 0.020 | 314.2 | 6934.5 | <100 | 538.0 |
| MGRM-F1-015 | 0.179 | >50 | <100 | 145.7 | <100 | 234.0 |
| MGRM-F1-016 | 0.268 | 0.518 | 110.3 | 103.0 | <100 | 407.0 |
| MGRM-F1-017 | 2.383 | >50 | <100 | 279.4 | <100 | 832.0 |
| MGRM-F1-018 | 0.027 | 0.019 | 770.0 | 518.6 | 151.2 | 391.0 |

TABLE 58D-continued

| | | | | | | |
|---|---|---|---|---|---|---|
| MGRM-F1-020 | 5.987 | 6.396 | 305.4 | 220.8 | <100 | 306.0 |
| MGRM-F1-021 | 0.031 | >50 | 227.6 | 505.7 | 218.7 | 919.0 |
| MGRM-F1-022 | 0.072 | 0.028 | 350.0 | 1296.4 | 221.3 | 638.0 |
| MGRM-F1-023 | 0.171 | >50 | 362.3 | 337.3 | 674.5 | 2177.0 |

TABLE 58E

| | | IC$_{50}$ (μg/mL)$^a$ | | | | | |
|---|---|---|---|---|---|---|---|
| Isolate | Subtype | PGT-121 | PGT-122 | PGT-123 | PGT-125 | PGT-126 | PGT-127 |
| MGRM-G-001 | G | 0.004 | 0.005 | 0.009 | 0.033 | 0.038 | 0.113 |
| MGRM-G-004 | | 0.115 | 2.146 | 0.181 | >50 | >50 | >50 |
| MGRM-G-006 | | >50 | >50 | >50 | >50 | >50 | >50 |
| MGRM-G-009 | | 0.020 | 0.514 | 33.546 | >50 | >50 | >50 |
| MGRM-G-011 | | 3.167 | 31.299 | 14.900 | >50 | 7.318 | >50 |
| MGRM-G-013 | | 3.991 | 3.448 | 3.969 | >50 | 48.845 | 7.699 |
| MGRM-G-014 | | 0.009 | 0.008 | 0.005 | 0.007 | 0.009 | 0.009 |
| MGRM-G-015 | | >50 | >50 | >50 | >50 | >50 | >50 |
| MGRM-G-016 | | >50 | >50 | >50 | >50 | >50 | >50 |
| MGRM-G-017 | | 0.004 | 0.032 | 0.026 | >50 | >50 | >50 |
| MGRM-G-019 | | 0.011 | 0.016 | 0.008 | >50 | 0.018 | 0.429 |
| MGRM-G-024 | | 0.014 | 0.033 | 0.032 | >50 | >50 | >50 |
| MGRM-G-025 | | 0.063 | 0.079 | 0.046 | >50 | 17.054 | 19.279 |
| MGRM-G-027 | | 0.124 | 0.606 | 0.182 | 34.414 | 0.875 | >50 |
| MGRM-G-028 | | 0.014 | 0.010 | 0.008 | 0.012 | 0.012 | 0.032 |
| aMLV | negative | >50 | >50 | >50 | >50 | >50 | >50 |

| | IC$_{50}$ (μg/mL)$^a$ | | | | | |
|---|---|---|---|---|---|---|
| Isolate | PGT-128 | PGT-130 | PGT-131 | PGT-135 | PGT-136 | PGT-137 |
| MGRM-G-001 | 0.019 | 0.0198 | 0.404 | 0.393 | 8.113 | 41.703 |
| MGRM-G-004 | >50 | >50 | >50 | >50 | >50 | >50 |
| MGRM-G-006 | >50 | >50 | >50 | >50 | >50 | >50 |
| MGRM-G-009 | >50 | >50 | >50 | >50 | >50 | >50 |
| MGRM-G-011 | 8.212 | >50 | >50 | >50 | >50 | >50 |
| MGRM-G-013 | 0.995 | >50 | >50 | >50 | >50 | >50 |
| MGRM-G-014 | 0.004 | 2.226 | 4.313 | >50 | >50 | >50 |
| MGRM-G-015 | >50 | >50 | >50 | >50 | >50 | >50 |
| MGRM-G-016 | >50 | >50 | >50 | >50 | >50 | >50 |
| MGRM-G-017 | 0.319 | >50 | >50 | 0.137 | >50 | 34.905 |
| MGRM-G-019 | 0.010 | 27.938 | >50 | 0.145 | 44.285 | 0.126 |
| MGRM-G-024 | 0.095 | 5.838 | 10.730 | 0.062 | 0.152 | 0.051 |
| MGRM-G-025 | 0.017 | 8.452 | 7.750 | 0.592 | >50 | >50 |
| MGRM-G-027 | 0.313 | 4.137 | 2.904 | 0.062 | 45.222 | 0.228 |
| MGRM-G-028 | 0.008 | 0.074 | 0.466 | >50 | >50 | >50 |
| aMLV | >50 | >50 | >50 | >50 | >50 | >50 |

| | | IC$_{50}$ (μg/mL)$^a$ | | | | | |
|---|---|---|---|---|---|---|---|
| Isolate | Subtype | PGT-141 | PGT-142 | PGT-143 | PGT-144 | PGT-145 | VRC01 |
| MGRM-G-001 | G | 0.392 | 0.362 | 0.423 | >50 | 0.028 | 0.0371 |
| MGRM-G-004 | | >50 | >50 | >50 | >50 | >50 | >50 |
| MGRM-G-006 | | 0.043 | 0.019 | 0.031 | 3.843 | 0.286 | 0.055 |
| MGRM-G-009 | | 1.890 | 2.811 | 2.968 | >50 | 0.982 | 0.073 |
| MGRM-G-011 | | 0.086 | 0.046 | 0.074 | 1.577 | 0.028 | 0.065 |
| MGRM-G-013 | | >50 | >50 | >50 | >50 | >50 | 0.553 |
| MGRM-G-014 | | 0.222 | 0.076 | 0.107 | 0.562 | 0.144 | 0.056 |
| MGRM-G-015 | | >50 | >50 | >50 | >50 | 10.465 | 0.548 |
| MGRM-G-016 | | 4.690 | 8.170 | 7.600 | >50 | 0.081 | 0.063 |
| MGRM-G-017 | | 0.164 | 0.125 | 0.107 | 9.972 | 0.205 | 0.124 |
| MGRM-G-019 | | 20.310 | 5.949 | 4.773 | >50 | 0.041 | 0.060 |
| MGRM-G-024 | | 0.051 | 0.054 | 0.048 | 7.923 | 0.060 | 0.025 |
| MGRM-G-025 | | >50 | >50 | >50 | >50 | >50 | 0.292 |
| MGRM-G-027 | | >50 | >50 | >50 | >50 | 0.433 | 0.360 |
| MGRM-G-028 | | 24.888 | 30.309 | 42.988 | >50 | 0.046 | 0.164 |
| aMLV | negative | >50 | >50 | >50 | >50 | >50 | >50 |

| | IC$_{50}$ (μg/mL)$^a$ | | IC$_{50}$ (1/dil'n)$^b$ | | | |
|---|---|---|---|---|---|---|
| Isolate | PGV04 | PG9 | #17 | #84 | #36 | #39 |
| MGRM-G-001 | >50 | 0.166 | 5296.0 | 557.6 | 635.9 | 169.0 |
| MGRM-G-004 | >50 | >50 | 600.5 | 157.8 | 107.3 | 574.0 |
| MGRM-G-006 | 0.083 | 1.983 | <100 | 548.1 | <100 | <100 |

TABLE 58E-continued

| | | | | | | |
|---|---|---|---|---|---|---|
| MGRM-G-009 | 0.043 | 10.704 | 160.3 | 336.3 | <100 | 345.0 |
| MGRM-G-011 | 0.780 | 0.335 | <100 | 641.1 | <100 | 891.0 |
| MGRM-G-013 | 0.168 | >50 | 100.5 | 561.4 | 480.3 | 629.0 |
| MGRM-G-014 | 0.056 | 16.478 | 3593.6 | 389.5 | 1058.0 | 295.0 |
| MGRM-G-015 | 0.333 | 6.599 | <100 | <100 | <100 | 266.0 |
| MGRM-G-016 | 0.019 | 1.363 | <100 | 681.8 | 106.0 | 440.0 |
| MGRM-G-017 | 0.065 | 0.104 | 1582.3 | 701.7 | 282.9 | 420.0 |
| MGRM-G-019 | 0.027 | 14.559 | 1416.7 | 253.3 | 354.8 | 524.0 |
| MGRM-G-024 | 0.033 | 0.163 | 1077.4 | 388.2 | 131.5 | 516.0 |
| MGRM-G-025 | 1.608 | >50 | 396.1 | 129.5 | 164.2 | 213.0 |
| MGRM-G-027 | 0.125 | 0.007 | 289.0 | 140.8 | 143.4 | 676.0 |
| MGRM-G-028 | 0.352 | 0.891 | 2769.4 | 522.4 | 1201.4 | 621.0 |
| aMLV | >50 | >50 | <100 | <100 | <100 | <100 |

TABLE 59

Binding activity PGT mAbs.

$EC_{50}$ (µg/ml)[a]

| Donor | mAb | WT JR-FL gp120 | JR-FL gp120 ΔV1/ΔV2 | JR-FL GP120 ΔV3 | Endo H treated JR-FL gp120 |
|---|---|---|---|---|---|
| #17 | 121 | 0.2 | 0.2 | >10 | >10 |
| | 122 | 0.3 | 0.3 | >10 | >10 |
| | 123 | 0.2 | 0.3 | >10 | >10 |
| #36 | 125 | 0.2 | 0.6 | >10 | >10 |
| | 126 | 0.1 | 0.3 | >10 | >10 |
| | 127 | 0.1 | 0.7 | >10 | >10 |
| | 128 | 0.1 | 0.3 | 7.8 | >10 |
| | 130 | 0.2 | >10 | >10 | >10 |
| | 131 | 0.4 | >10 | >10 | >10 |
| #39 | 135 | 0.1 | 0.1 | 0.2 | >10 |
| | 136 | 0.2 | 0.3 | 0.1 | >10 |
| | 137 | 0.1 | 0.2 | 0.1 | >10 |

[a]Binding was evaluated by ELISA. $EC_{50}$ values were derived by nonlinear regression analysis.
Experiments were performed in duplicate, and data represent an average of at least two independent experiments.

Figure 33A:
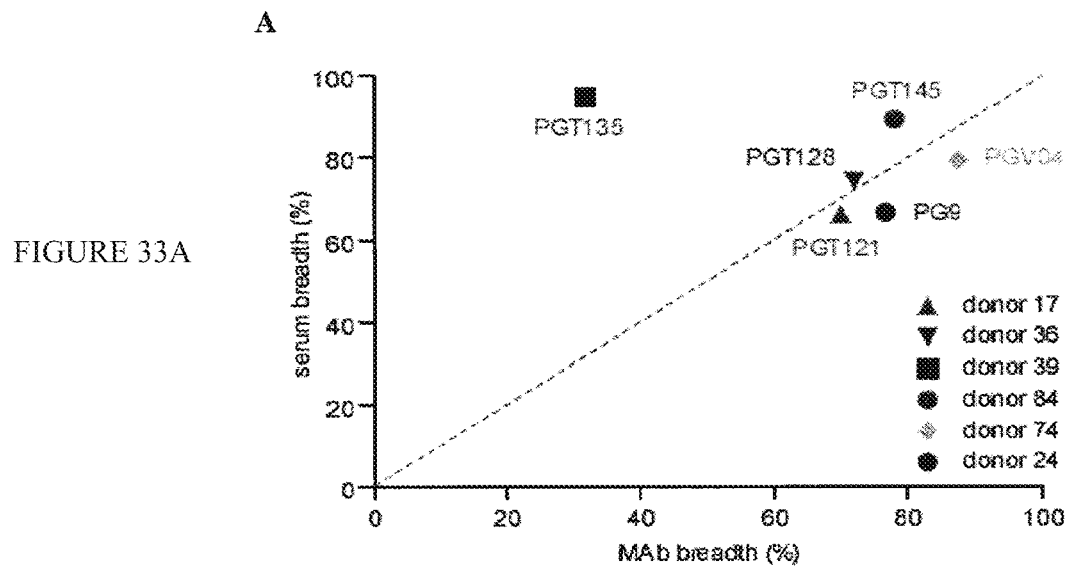

Many of the clonally related mAbs exhibited differing degrees of overall neutralization potency. For example, the median $IC_{50}$s of PGTs 131, 136, 137, and 144 were approximately 10- to 50-fold higher than those of their somatically-related sister clones (Table 61). Also, in some cases, the somatically-related mAbs exhibited similar neutralization potency, but differing degrees of neutralization breadth, against the panel of viruses tested (Tables 58A-E and Table 61). For example, PGT-128 neutralized with comparable overall potency but significantly greater neutralization breadth than the clonally related PGT-125, -126, and -127 mAbs (Tables 58A-E and Table 61). Overall, these observations suggest that serum neutralization breadth may develop from the successive selection of somatic mutants that bind to a modified epitope or a slightly different envelope (Env) conformation expressed on virus escape variants. Additionally, these results indicate that the full serum neutralization breadth and potency may be mediated by a small number of sequentially selected mAbs that bind to distinct, but overlapping, epitopes differentially expressed on various isolates. In this respect, antibody somatic variants could in effect "slide" around the Env spike surface. Comparison of the neutralization profiles of the mAbs isolated from a given donor with the profiles from the sera revealed that the mAbs isolated could largely recapitulate the corresponding serum neutralization breadth and potency (FIGS. 33a and 37).

The epitopes recognized by the newly isolated bnMAbs were determined. ELISA binding assays indicated that PGTs 121-123, 125-128, 130, 131, and 135-137 bound to monomeric gp120 (Table 59). In contrast, the PGT 141-145 bnMAbs exhibited a strong preference for membrane-bound, trimeric HIV-1 Env (FIG. 38). Based on this result, it was postulated that these bnMAbs bound to quaternary epitopes similar to those of the recently described PG9 and PG16 bnMAbs (Walker, L. M., et al. Science 326, 285-289 (2009)). Indeed, this hypothesis was confirmed by competition studies, N160K sensitivity, and, for PGTs 141-144, an inability to neutralize JR-CSF pseudoviruses expressing homogenous $Man_9GlcNAc_2$ glycans (Walker, L. M., et al. PLoS Pathog 6(2010)) (FIG. 39).

To define the epitopes recognized by the remaining PGT antibodies, competition ELISA assays were carried out with a panel of well-characterized neutralizing and non-neutralizing antibodies (FIG. 34a). Unexpectedly, all of the remaining antibodies (PGTs 121-123, 125-128, 130, 131, 135-137) competed with the glycan-specific bnMAb 2G12. This result was surprising given that 2G12 had previously formed its own unique competition group. All of the mAbs except for PGTs 135, 136 and 137 also competed with a V3 loop-specific mAb and failed to bind to gp120 ΔV3, suggesting their epitopes were in proximity to or contiguous with the V3 loop (FIG. 34a and Table 59). Deglycosylation of gp120 with Endo H abolished binding by all the mAbs, indicating that certain oligomannose glycans were important for epitope recognition (Table 59). Competition of these mAbs with 2G12 and lack of binding to deglycosylated gp120 prompted us to investigate whether these antibodies contacted glycans directly. Glycan array analysis revealed that PGTs 125-128, and 130 bound specifically to both $Man_8GlcNAc2$ and $Man_9GlcNAc2$, whereas the remaining antibodies showed no detectable binding to high-mannose glycans (FIG. 34b). Interestingly, the binding of PGTs 125-128, 130 to gp120 was competed by Mang but, unlike 2G12, was not competed by monomeric mannose or Maria (D1 arm of $Man_9GlcNAc2$) (FIGS. 34c and 34d), suggesting a different mode of glycan recognition. Furthermore, in contrast to 2G12, no evidence was found for domain exchange and monomeric Fab fragments exhibited potent neutralizing activity (FIG. 41).

To further define the epitopes recognized by the mAbs, neutralizing activity against a large panel of HIV-1$_{JR-CSF}$ variants incorporating single alanine substitutions was assessed using a single round of replication pseudovirus assay (Table 60). In the panel of mutants, the N-linked glycans at positions 332 and/or 301 were important for neutralization by PGTs 125-128, 130, and 131 suggesting their direct involvement in epitope formation. The apparent dependency on so few glycans suggests that, although PGTs 125-128, 130, and 131 contact $Man_{8-9}GlcNAc_2$ glycans directly, their arrangement in the context of gp120 is critical for high affinity glycan recognition and neutralization potency. This is further highlighted by the inability of PGT Mabs to neutralize SIVmac239, HIV-2 or HCV, which display a high level of glycosylation. Although PGTs 121-123 failed to exhibit detectable binding to high-mannose glycans and be competed by mannose sugars (FIG. 40), the only substitutions that completely abolished neutralization by these mAbs were those that resulted in removal of the glycan at position 332. Although structural studies will be required to fully define the epitopes recognized by these antibodies, the above result suggests either that the PGT 121-123 mabs bind to a protein epitope along the gp120 polypeptide backbone that is conformationally dependent on the N332 glycan or that the glycan contributes more strongly to binding in the context of the intact protein.

TABLE 60

Neutralizing activity of PGT mAbs against a panel of JR-CSF alanine mutants.

| Mutation[a] | gp120 domain[b] | PGT-121 | PGT-122 | PGT-123 | PGT-125 | PGT-126 | PGT-127 | PGT-128 | PGT-130 | PGT-131 | PGT-135 |
|---|---|---|---|---|---|---|---|---|---|---|---|
| | | | | | A. | | | | | | |
| D113A | C1 | 1.2 | 1.0 | 1.1 | 1.1 | 1.2 | 0.3 | 0.5 | 0.8 | ND | 0.8 |
| V120A | | 0.8 | 1.2 | 1.1 | 0.5 | 0.7 | 1.5 | 1.4 | 0.8 | 0.7 | 1.4 |
| L125A | | 0.9 | 2.4 | 2.5 | 1.6 | 1.2 | 1.4 | 2.9 | 2.5 | 2.5 | 0.9 |
| V127A | | 0.7 | 1.0 | 1.2 | 0.9 | 1.3 | 2.5 | 1.1 | 0.8 | 0.6 | 1.4 |
| N134A | V1 | 0.2 | 0.3 | 0.4 | 0.5 | 0.6 | 1.0 | 1.2 | 0.6 | 0.5 | 0.2 |
| N156A | V2 | 0.9 | 1.1 | 6.2 | 3.6 | 1.8 | 1.6 | 0.4 | 1.5 | 1.0 | 0.3 |
| N160K | | 1.1 | 1.1 | 1.0 | 0.5 | 0.5 | 0.8 | 1.0 | 3.4 | 0.4 | 7.7 |
| T162A | | 0.3 | 0.6 | 0.7 | 0.5 | 0.6 | 1.1 | 1.1 | 0.6 | 0.6 | 0.9 |
| I165A | | 3.3 | 3.0 | 2.2 | 2.3 | 2.5 | 1.7 | 2.1 | 3.2 | 2.4 | 4.0 |
| R166A | | 1.4 | 0.9 | 0.9 | 1.5 | 1.0 | 1.6 | 2.7 | 1.2 | 1.6 | 0.9 |
| D167A | | 1.0 | 1.1 | 1.2 | 1.7 | 1.6 | 1.6 | 0.3 | 1.2 | 1.2 | 0.7 |
| K168A | | 1.5 | 0.8 | 0.8 | 0.9 | 0.7 | 1.9 | 1.1 | 1.2 | 1.7 | 0.4 |
| E172A | | 1.4 | 1.0 | 1.1 | 1.8 | 0.7 | 2.1 | 2.5 | 1.4 | ND | 1.3 |
| Y177A | | 1.4 | 2.4 | 2.4 | 1.1 | 0.9 | 2.9 | 1.4 | 3.6 | 5.3 | 0.3 |
| L179A | | 1.9 | 1.1 | 1.2 | 1.3 | 2.6 | 2.5 | 2.8 | 2.4 | 4.8 | 1.2 |
| V182A | | 2.1 | 2.2 | 2.8 | 1.3 | 1.4 | 1.6 | 1.2 | 1.2 | 1.1 | 1.5 |
| D185A | | 1.0 | 1.8 | 1.9 | 0.6 | 1.0 | 2.0 | 1.5 | 0.9 | 0.7 | 1.3 |
| N188A | | 0.8 | 1.0 | 1.1 | 0.7 | 0.8 | 0.8 | 1.3 | 1.0 | 0.9 | 0.4 |
| N197A | C2 | 1.1 | 1.4 | 1.4 | 1.0 | 1.1 | 0.6 | 1.0 | 1.2 | 1.1 | 0.3 |
| S199A | (V1/V2 | 0.8 | 1.0 | 1.1 | 0.7 | 0.8 | 3.0 | 1.0 | 0.9 | 1.6 | 0.3 |
| T202A | stem) | 1.2 | 1.5 | 1.2 | 0.8 | 0.8 | 1.8 | 1.1 | 1.2 | 2.7 | 1.8 |
| F210A | C2 | 1.5 | 2.6 | 2.8 | 1.4 | 1.5 | 0.8 | 0.8 | 1.7 | 1.0 | 1.3 |
| N241A | | 0.5 | 1.4 | 0.8 | 0.5 | 0.6 | 0.6 | 0.7 | 0.6 | 0.7 | 0.1 |
| N262A | | 1.1 | 1.1 | 0.5 | 0.9 | 1.0 | 1.4 | 1.6 | 0.7 | 0.4 | 2.1 |
| N276A | | 0.8 | 1.4 | 1.1 | 0.9 | 0.9 | 1.6 | 0.6 | 1.0 | 0.8 | 2.5 |
| | | | | | B. | | | | | | |
| V292A | | 2.7 | 1.3 | 1.7 | 3.3 | 5.0 | 0.9 | 2.1 | 0.9 | 1.4 | 2.0 |
| N295A | V3 | 0.6 | 0.7 | 1.2 | 0.8 | 0.9 | 2.3 | 1.0 | 0.7 | 2.1 | >18 |
| T297A | | 0.7 | 0.6 | 0.3 | 0.9 | 0.8 | 1.7 | 1.1 | 0.9 | 1.2 | >30 |
| P299A | | 0.2 | 0.5 | 0.7 | 0.2 | 0.2 | 0.2 | 1.2 | 0.8 | 2.0 | 0.36 |
| N301A | | 0.4 | 0.4 | 1.0 | 213 | 314 | >250 | 10.7 | >1000 | >170 | 0.5 |
| N302A | | 0.7 | 1.1 | 1.3 | 0.7 | 0.9 | 3.0 | 1.5 | 1.1 | 1.0 | 0.8 |
| T303A | | 0.7 | 2.5 | 1.1 | >250 | >250 | >500 | >500 | >250 | >170 | 0.3 |
| R304A | | 1.7 | 0.7 | 0.7 | 1.9 | 1.8 | 0.4 | 0.7 | 2.5 | 1.5 | 0.7 |
| K305A | | 1.9 | 3.0 | 1.9 | 1.9 | 1.0 | 2.6 | 1.8 | 6.9 | ND | 0.2 |
| S306A | | 0.7 | 0.5 | 0.5 | 1.2 | 0.7 | 0.6 | 1.1 | 1.5 | 0.7 | 0.4 |
| I307A | | 3.7 | 3.8 | 5.9 | 5.0 | 1.8 | 10.2 | 3.7 | 1000.0 | >170 | 0.3 |
| I309A | | 1.1 | 2.1 | 1.6 | 1.0 | 1.2 | 6.0 | 2.8 | >77.9 | 8.8 | 0.3 |
| P313A | | 0.5 | 0.4 | 0.2 | 0.3 | 0.4 | 1.3 | 1.0 | 0.3 | 0.52 | 0.5 |
| R315A | | 0.9 | 0.5 | 0.7 | 0.9 | 1.0 | 0.3 | 0.4 | 0.6 | 0.7 | 1.8 |
| F317A | | 1.7 | 3.4 | 3.1 | 1.8 | 1.0 | 0.2 | 0.8 | 17.0 | 96 | 0.5 |
| T319A | | 1.3 | 0.5 | 0.4 | 1.1 | 0.8 | 1.0 | 0.5 | 1.6 | 0.9 | 0.4 |
| T320A | | 1.2 | 0.7 | 0.7 | 0.8 | 0.6 | 1.8 | 1.0 | 0.9 | 4.5 | 0.5 |
| E321aA | | 0.3 | 0.4 | 0.6 | 1.0 | 0.6 | 1.9 | 1.3 | 1.7 | 1.8 | 0.8 |
| I323A | | 1.9 | 2.2 | 1.0 | 0.9 | 0.9 | 4.0 | 3.0 | 0.8 | 38.0 | 1.5 |
| G324A | | 16.6 | 12.5 | 14.5 | 1.7 | 3.3 | ND | ND | >50 | ND | 0.4 |
| D325A | | 2.0 | 44.0 | 64.0 | 0.4 | 0.5 | 0.93 | 0.5 | >1000 | >170 | 0.5 |
| I326A | | 0.7 | 0.6 | 0.4 | 0.9 | 0.8 | 3.5 | 1.6 | 1.3 | 1.7 | 1.2 |
| R327A | | 2.5 | 1.7 | 1.7 | 2.1 | 2.2 | 1.8 | 2.5 | 2.4 | 19.0 | 0.67 |
| H330A | | 0.8 | 0.5 | 0.3 | 0.7 | 0.5 | 0.5 | 0.3 | 0.9 | 0.5 | >250 |
| N332A | | >200 | >200 | >200 | 2.0 | 181 | >100 | 1.4 | 0.6 | 0.5 | >250 |
| S334A | | >50 | >50 | >50 | 0.8 | >30 | >500 | 1.4 | 0.5 | 0.4 | >30 |
| Q337A | C3 | 1.0 | 0.5 | 0.5 | 0.8 | 0.4 | 0.5 | 0.7 | 1.0 | 1.3 | 2.1 |
| N339A | | 0.5 | 0.4 | 0.8 | 0.9 | 0.6 | 1.1 | 0.8 | 0.2 | 1.0 | 1.2 |
| T341A | | 0.5 | 0.3 | 0.3 | 1.1 | 0.5 | 1.7 | 1.3 | 0.8 | 1.3 | 0.6 |
| K343A | | 0.6 | 0.3 | 0.3 | 0.7 | 1.2 | 1.0 | 1.0 | 1.1 | 1.1 | 1.1 |
| R350A | | 0.8 | 0.6 | 0.5 | 0.6 | 0.7 | 1.1 | 0.5 | 1.3 | 0.9 | 0.9 |
| N355A | | 1.4 | 0.8 | 0.5 | 1.2 | 0.2 | 1.4 | 0.7 | 1.3 | 2.3 | 0.8 |
| N386A | | 1.3 | 1.2 | 1.4 | 0.8 | 0.9 | 0.6 | 1.1 | 0.1 | 1.1 | 0.3 |
| S387A | | 0.5 | 0.9 | 0.9 | 0.6 | 0.6 | 1.0 | 1.2 | 0.7 | 1.1 | 0.6 |
| T388A | | 0.9 | 0.3 | 0.2 | 0.6 | 0.6 | 0.5 | 1.0 | 1.0 | 0.6 | 0.1 |

TABLE 60-continued

Neutralizing activity of PGT mAbs against a panel of JR-CSF alanine mutants.

| | | Fold IC$_{50}$ increase relative to wild-type[c] | | | | | | | | | |
|---|---|---|---|---|---|---|---|---|---|---|---|
| Mutation[a] | gp120 domain[b] | PGT-121 | PGT-122 | PGT-123 | PGT-125 | PGT-126 | PGT-127 | PGT-128 | PGT-130 | PGT-131 | PGT-135 |
| | | | | | C. | | | | | | |
| N392Q | V4 | 0.9 | 1.0 | 1.0 | 1.2 | 1.6 | 1.1 | 0.9 | 1.2 | 0.4 | >250 |
| S393A | | 0.6 | 0.5 | 0.6 | 0.5 | 0.5 | 1.2 | 1.4 | 0.7 | 1.1 | 0.9 |
| T394A | | 0.2 | 0.6 | 0.4 | 0.6 | 0.6 | 1.6 | 3.0 | 1.2 | 0.9 | >75 |
| W395A | | 0.5 | 0.4 | 0.4 | 0.9 | 0.6 | 1.6 | 0.8 | 0.6 | 0.5 | 0.6 |
| N396A | | 1.3 | 1.1 | 1.2 | 1.6 | 1.7 | 2.4 | 0.9 | 1.0 | 0.9 | 1 |
| N411A | | 0.4 | 0.7 | 0.5 | 0.5 | 0.7 | 0.8 | 0.7 | 0.6 | 0.6 | 0.2 |
| T413A | | 0.5 | 0.8 | 0.4 | 0.5 | 0.7 | 0.8 | 1.0 | 0.6 | 0.6 | 0.3 |
| I414A | | 0.5 | 0.5 | 0.3 | 0.3 | 0.4 | 2.2 | 1.4 | 0.7 | 1.0 | 1.2 |
| I415A | | 0.6 | 0.4 | 0.4 | 0.3 | 0.3 | 2.1 | 0.7 | 0.6 | 0.6 | 5 |
| L416A | | 0.6 | 1.0 | 0.9 | 0.8 | 0.8 | 1.0 | 1.1 | 1.0 | 1.0 | 1.2 |
| D417A | | 0.7 | 0.5 | 0.7 | 0.5 | 1.0 | 0.4 | 0.5 | 1.0 | 1.0 | 5.0 |
| R419A | C4 | 1.8 | 0.8 | 0.7 | 1.0 | 1.2 | 2.5 | 0.5 | 2.6 | 1.7 | 3.9 |
| I420A | | 3.3 | 3.5 | 3.2 | 1.1 | 0.6 | 1.8 | 0.8 | 9.8 | 153 | 1.4 |
| K421A | | 1.3 | 1.2 | 0.9 | 1.2 | 0.7 | 1.5 | 2.0 | 2.9 | 11.0 | 0.3 |
| Q422A | | 1.2 | 1.1 | 0.8 | 1.2 | 1.1 | 0.1 | 0.2 | 1.0 | 1.9 | 0.8 |
| I4234 | | 3.3 | 2.8 | 1.5 | 5.0 | 1.1 | 0.5 | 2.6 | >1000 | >80 | 0.1 |
| I424A | | 0.9 | 0.8 | 0.5 | 0.7 | 0.4 | 2.0 | 1.3 | 3.9 | 4.8 | 0.1 |
| E466A | V5 | 1.2 | 0.9 | 0.60 | 1.6 | 1.4 | 0.9 | 0.6 | 1.7 | 1.7 | 0.5 |
| F468A | | 0.8 | 1.0 | 0.50 | 1.0 | 0.7 | 3.0 | 0.5 | 0.4 | 1.6 | 1.1 |
| P470A | | 0.9 | 2.1 | 0.8 | 1.6 | 2.7 | 1.0 | 0.6 | 2.4 | 1.0 | 0.8 |
| G471A | | 0.8 | 1.8 | 1.3 | 1.0 | 1.2 | 1.2 | 0.9 | 0.8 | 1.2 | 3 |
| D474A | | 1.3 | 1.8 | 1.1 | 1.4 | 3.3 | 1.5 | 0.8 | 2.0 | 1.6 | 1.2 |
| R476A | | 1.1 | 0.9 | 2.0 | 1.9 | 1.5 | 1.2 | 0.7 | 1.3 | 1.0 | 0.8 |
| D477A | | 1.9 | 0.9 | 2.3 | 3.4 | 1.1 | 1.7 | 0.7 | 1.1 | 1.0 | 1.5 |
| N478A | | 0.8 | 0.9 | 0.6 | 1.5 | 1.0 | 1.2 | 0.8 | 0.8 | 1.0 | 0.7 |
| R480A | | 0.8 | 1.4 | 1.7 | 2.1 | 1.9 | 0.2 | 0.1 | 1.0 | 1.5 | 1.4 |

[a]Amino acid numbering is based on the sequence of HIV-1$_{HxB2}$
[b]C refers to constant domains and V refers to variable loops.
[c]Neutralization activity is reported as fold increase in IC$_{50}$ value relative to WT JR-CSF and was calculated using the equation (IC$_{50}$mutant/IC$_{50}$WT). Experiments were performed in duplicate and values represent an average of at least two independent experiments.

Vaccines against pathogens with low antigenic diversity, such as hepatitis B virus (HBV) or measles, commonly achieve 90-95% efficacy (Plotkin. Vaccines (Elsevier Health Sciences, Philadelphia, 2008)). Similarly, the influenza vaccine achieves 85-90% efficacy in years when the vaccine and circulating strain are well-matched (Bridges, C. B., et al. JAMA 284, 1655-1663 (2000); Herrera, G. A., et al. Vaccine 25, 154-160 (2007)). However, efficacy drops severely in years when there is a mismatch between the vaccine and circulating strain. In the case of HIV, the global diversity of circulating viruses is such that the match between the prophylactic antibodies and the circulating viruses, i.e. the antibody viral coverage, will be crucial for the degree of efficacy of active or passive prophylaxis approaches. To date, although the recent RV144 trail has led to speculation that some degree of protection against HIV may be achieved through extra-neutralizing activities of antibodies, such as antibody-dependent cell-mediated cytotoxicity or phagocytosis, the strongest evidence for protection is for neutralizing antibodies in non-human primate models using simian-human immunodeficiency virus (SHIV) challenge (Parren, P. W., et al. J Virol 75, 8340-8347 (2001); Nishimura, Y., et al. J Virol 76, 2123-2130 (2002); Hessell, A. J., et al. Nat Med 15, 951-954 (2009); Hessell, A. J., et al. PLoS Pathog 5, e1000433 (2009); Willey, R., et al. AIDS Res Hum Retroviruses 26, 89-98 (2010)).

Figure 33B:
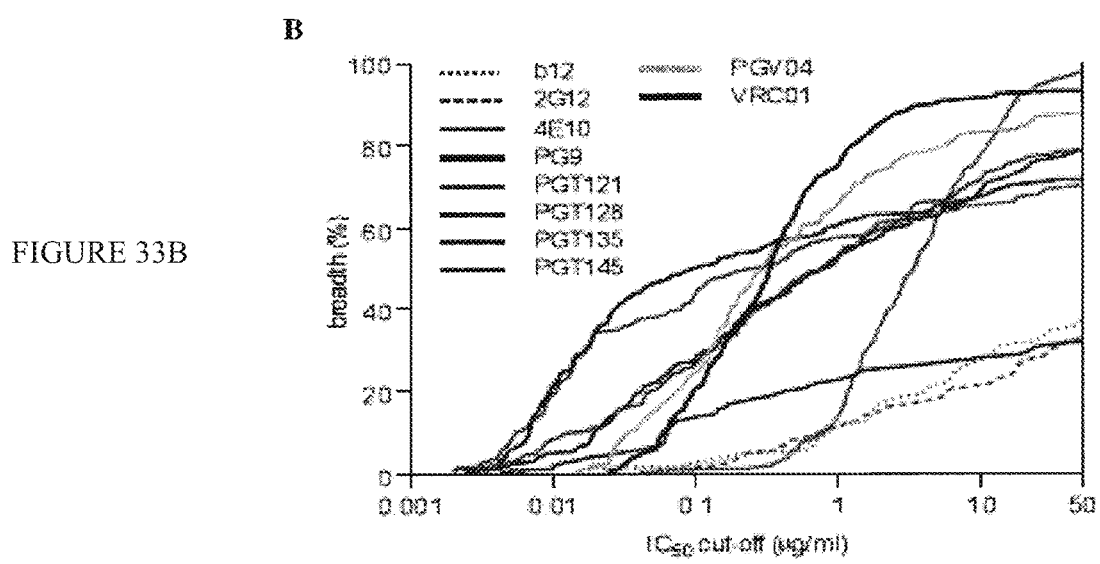
Figure 33C:
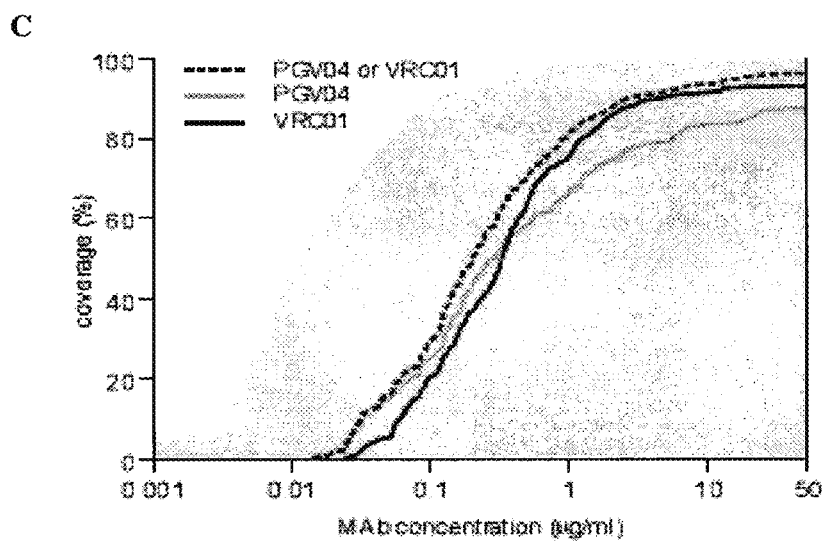
Figure 33D:
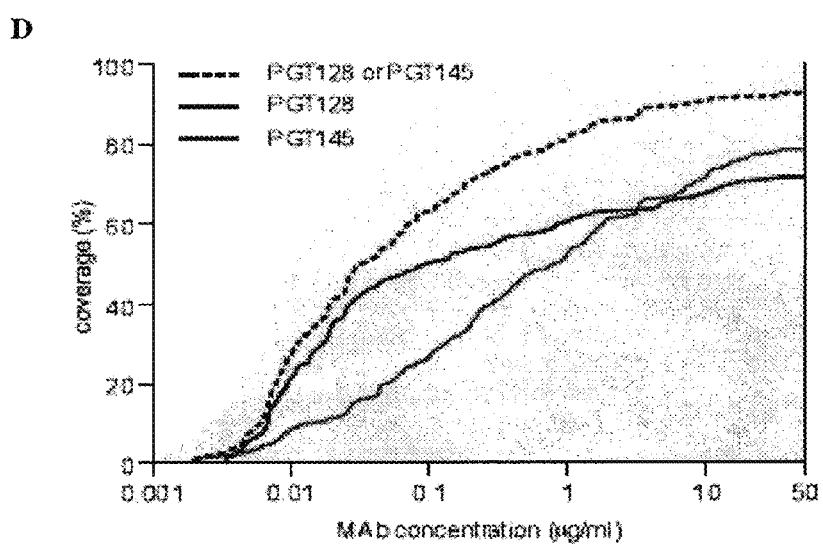
Figure 35A:
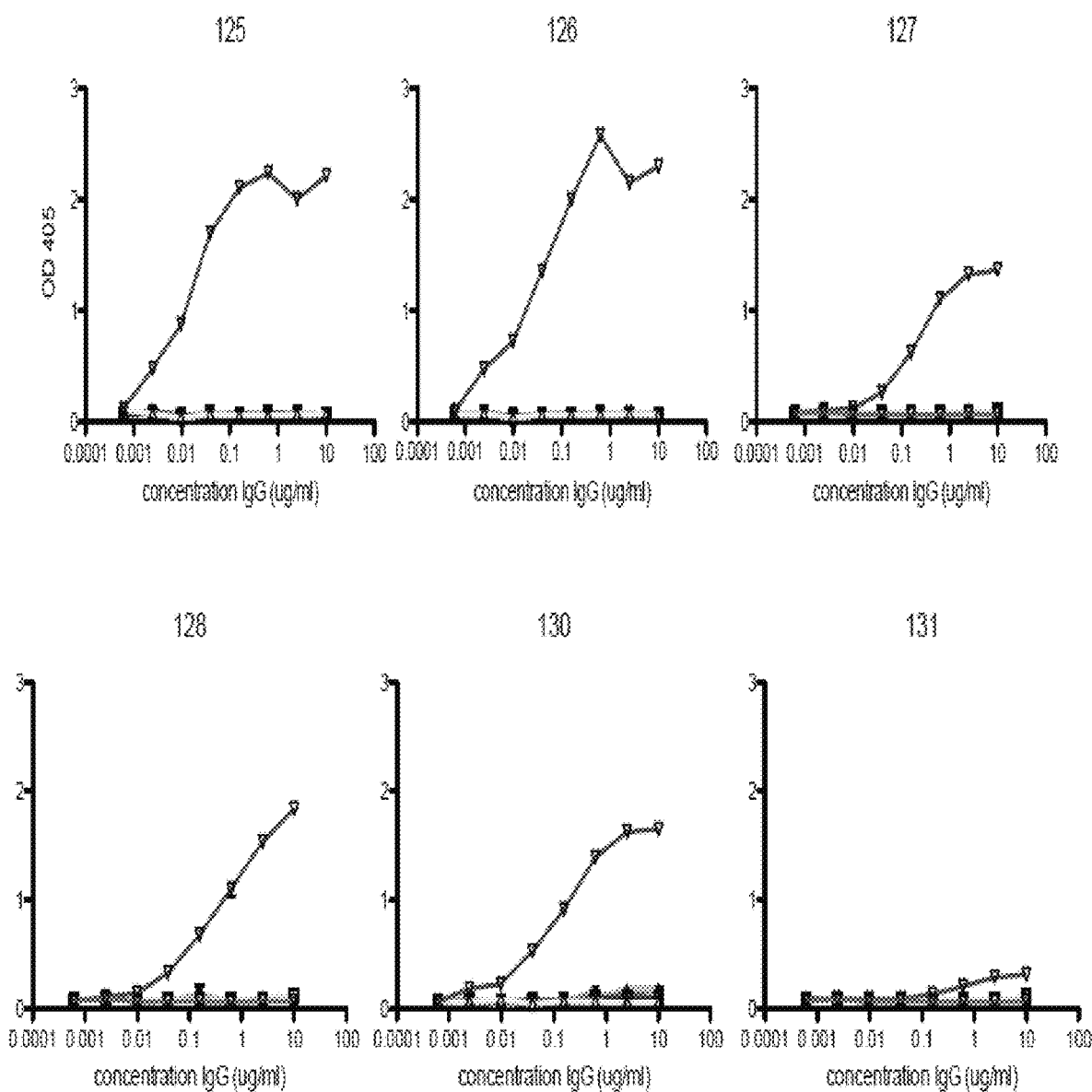
Figure 35B:
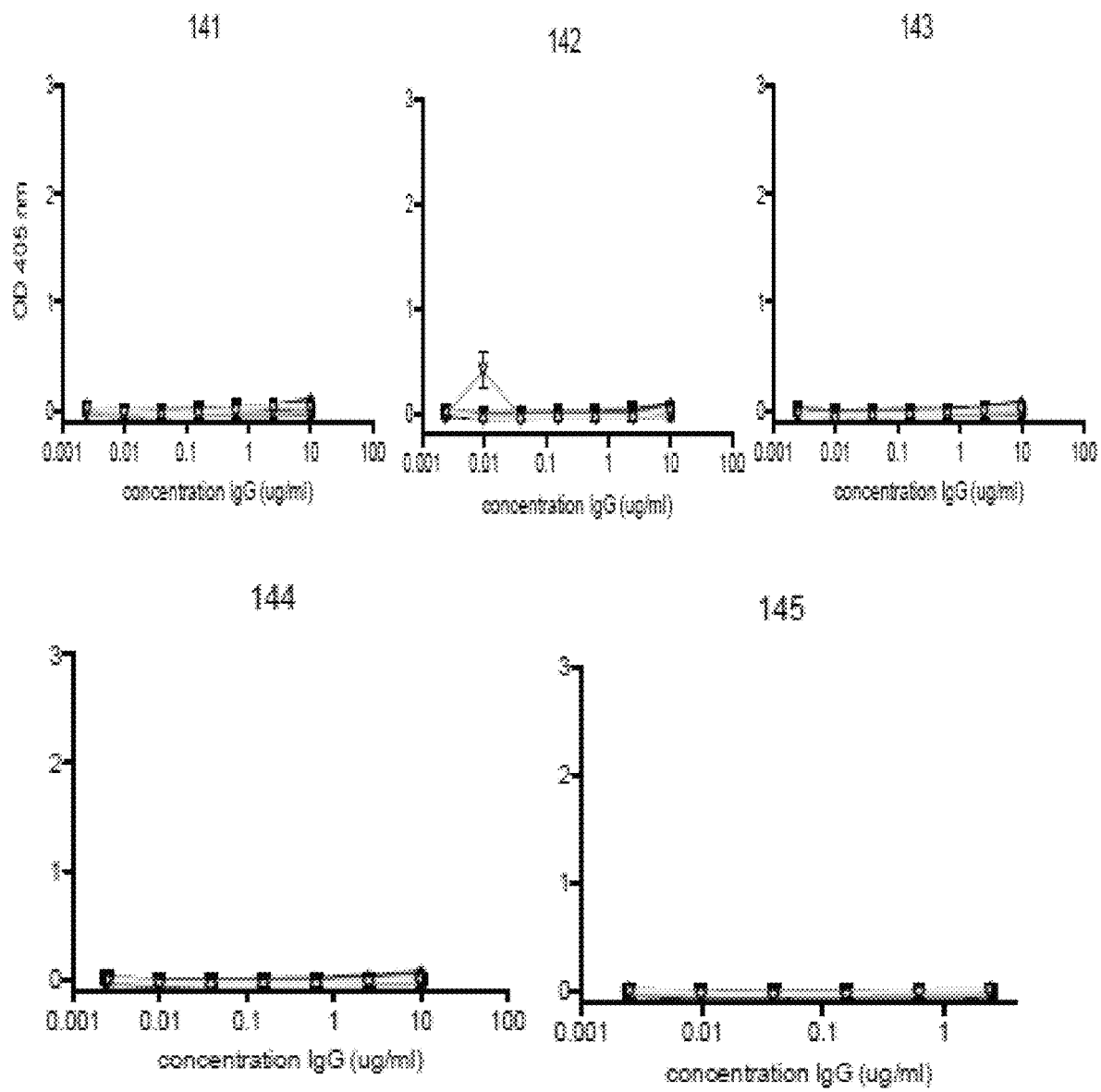
Figure 35C:
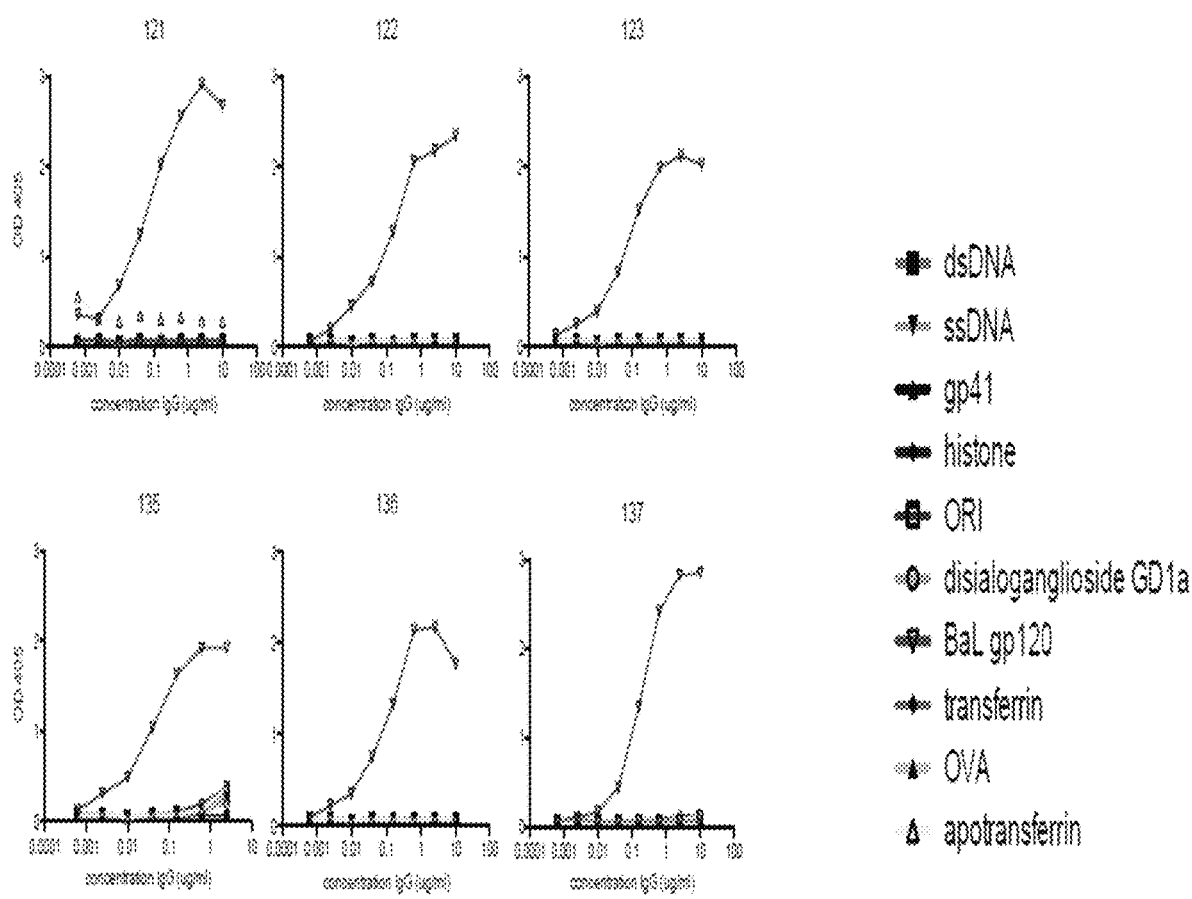
Figure 35D:
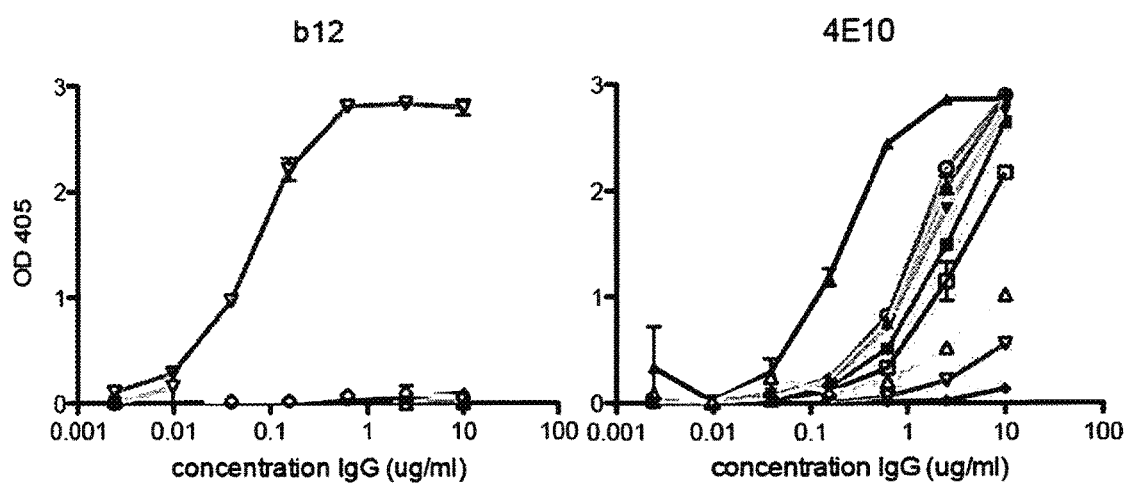
Figure 36A:
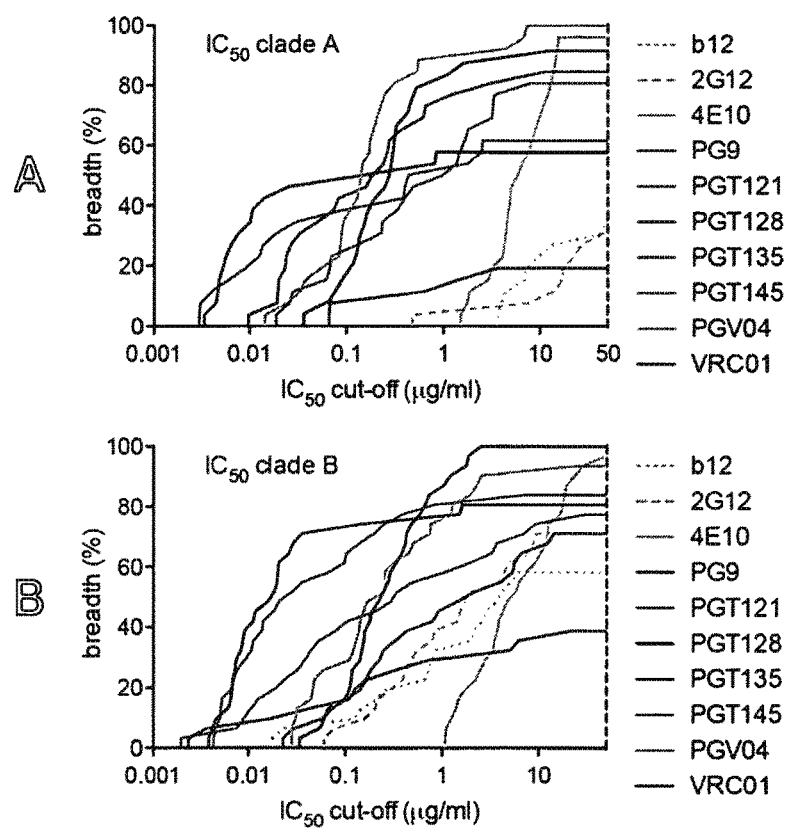
Figure 36B:
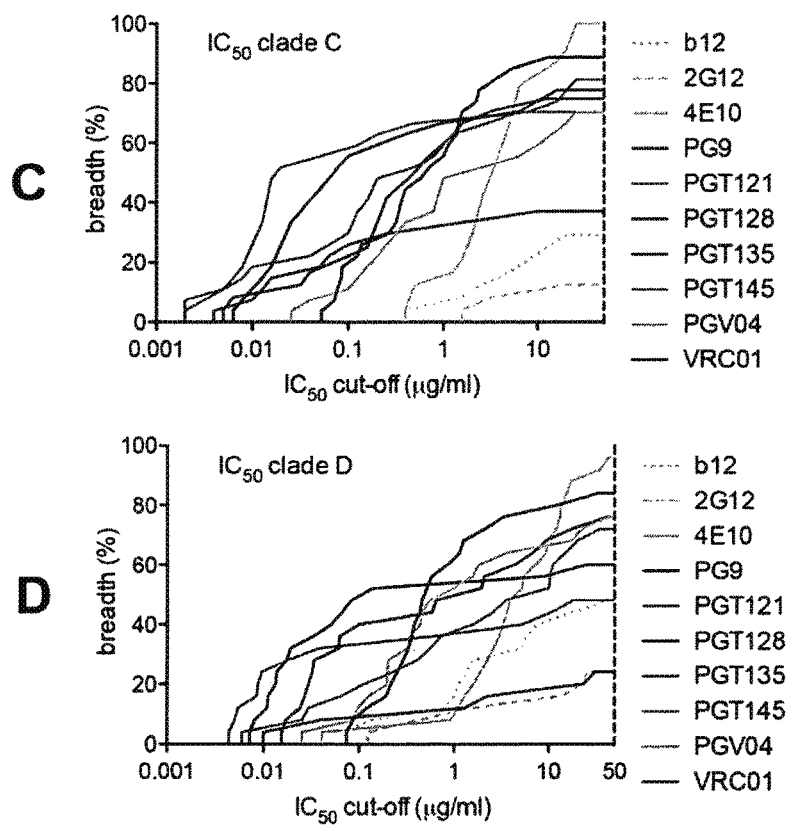
Figure 36C:
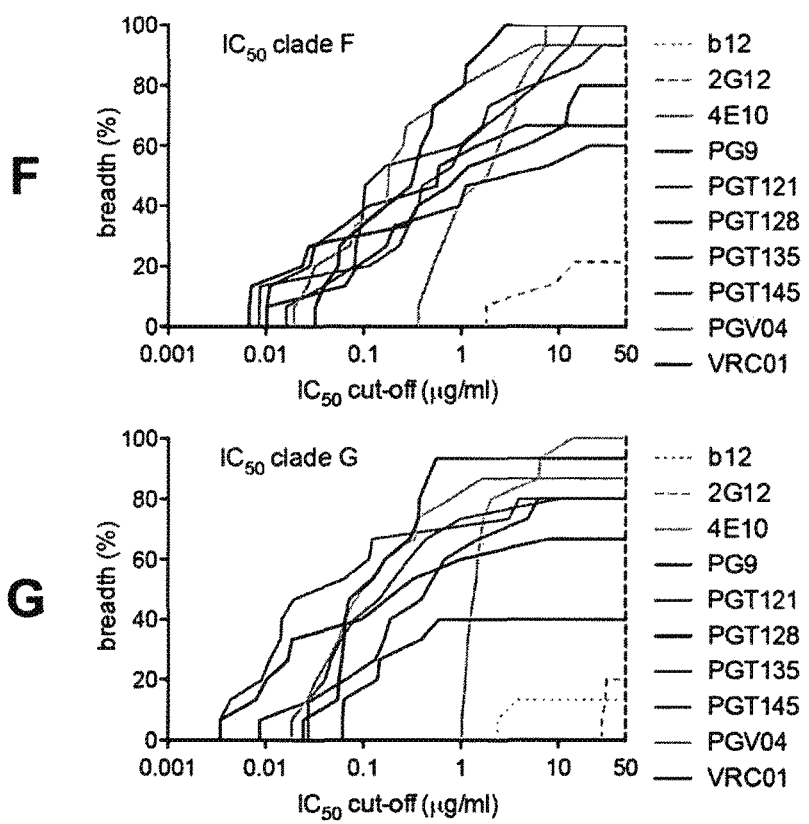
Figure 36D:
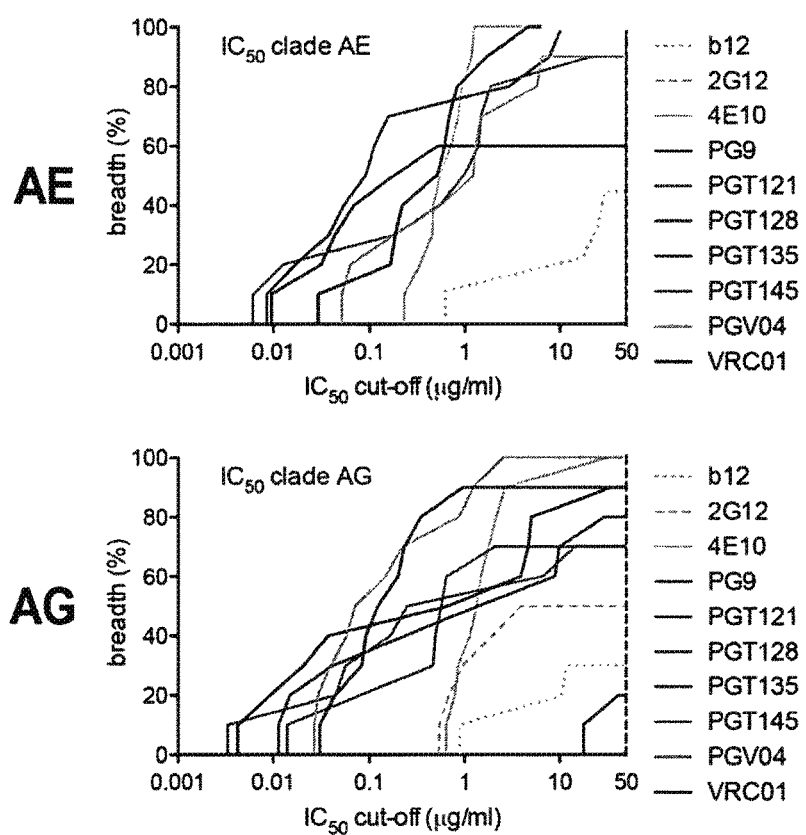
Figure 37A:
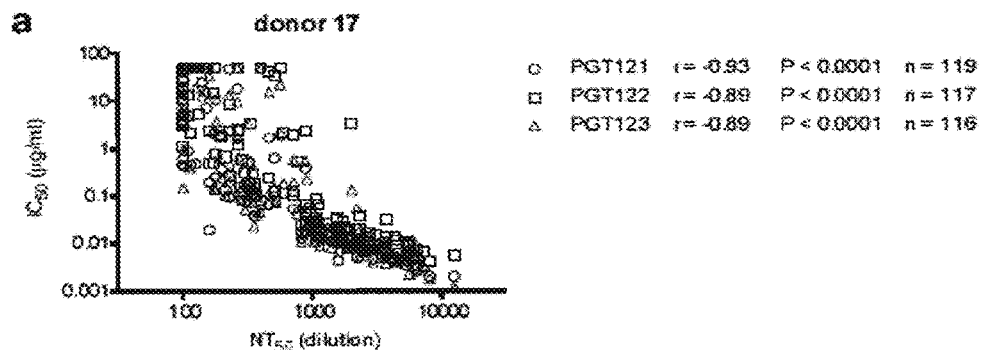
Figure 37B:
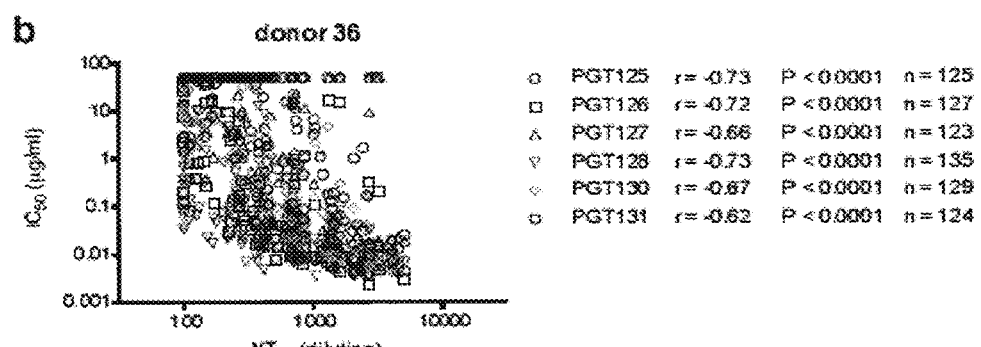
Figure 37C:
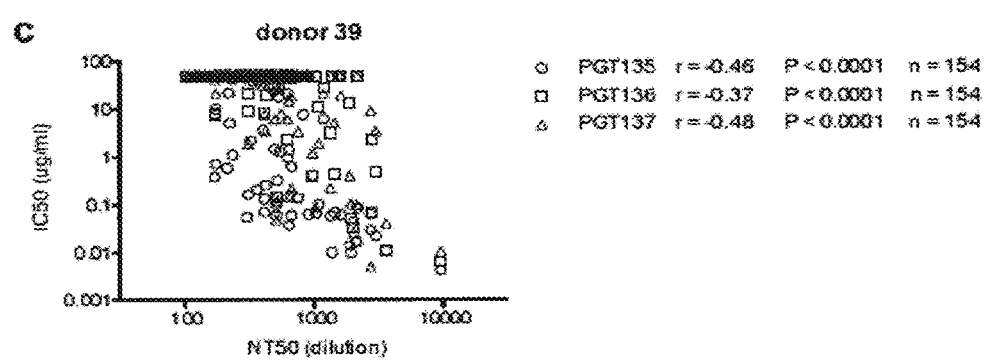
Figure 37D:
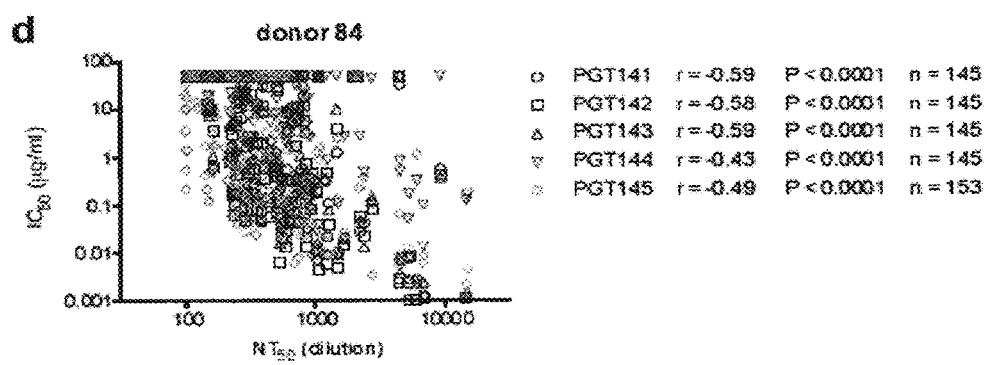

Passive administration of neutralizing antibodies in animal models suggest that a serum titer of approximately or greater than 100 times the IC$_{50}$ is often required to achieve a meaningful level of protection (Parren, P. W., et al. J Virol 75, 8340-8347 (2001); Nishimura, Y., et al. J Virol 76, 2123-2130 (2002); Hessell, A. J., et al. Nat Med 15, 951-954 (2009); Hessell, A. J., et al. PLoS Pathog 5, e1000433 (2009); Willey, R., et al. AIDS Res Hum Retroviruses 26, 89-98 (2010)). Therefore, if a vaccine elicits a serum bNAb concentration on the order of 10 μg/ml, and if an IC$_{50}$: protective serum ratio of 1:100 is assumed, then protection would be then be achieved by bNAb IC$_{50}$ is lower than 0.1 μg/ml. As a second conservative scenario, for an IC$_{50}$: protective serum ratio of 1:500, protection would be achieved against viruses for which the bNAb IC$_{50}$ is lower than 0.02 μs/ml. As shown in FIG. 33b-d, although various bnMAbs display breadth at high concentrations, viral coverage often drops sharply at lower concentrations. Therefore, if elicited or delivered singly, only the most potent Abs, such as 121 and 128, would be able to achieve a meaningful level of viral coverage, in particular at concentrations corresponding to the more conservative scenario given above. As bnMAbs display different and in some cases complementary breadth, we further looked at the coverage achieved by antibody combinations. For the two IC$_{50}$: protective serum concentration ratios above, a combination of PGV04 and VRC01, the two most potent CD4bs bnMAbs, would provide protection against 50% and 3% of viruses, respectively (FIG. 33c). In contrast, for a vaccine eliciting antibodies with high potency and favorable non-overlapping breadth, such as 128 and 145, coverage would be achieved against 70% and 40% of viruses for the two scenarios (FIG. 33d). Several combinations of two bnMAbs, including those directed to overlapping epitopes, can yield this degree of coverage (FIG. 44). In addition, a combination of all of the bnMAbs would cover 89% and 62% of viruses, correspondingly. Coverage against such a large proportion of viruses would likely have an important impact on the pandemic.

In summary, an effective vaccine against HIV-1 may require the elicitation of a combination of complementary potent neutralizing antibodies. The demonstration that large numbers of potent and diverse bNAbs can be isolated from several different individuals provides grounds for renewed optimism that an antibody-based vaccine is achievable. Critically, the instant invention provides the required large number of potent and diverse bNAbs that comprise an antibody-based vaccine.

Methods Summary

Activated memory B cell supernatants were screened in a high throughput format for neutralization activity using a micro-neutralization assay, as described (Walker, L. M., et al. Science 326, 285-289 (2009)). Heavy and light chain variable regions were isolated from B cell lysates of selected neutralizing hits by reverse transcription from RNA followed by multiplex PCR amplification using family-specific V-gene primer sets. For some antibodies, traditional cloning methods were used for antibody isolation, as described (Walker, L. M., et al. Science 326, 285-289 (2009)). For other antibodies, amplicons from each lysate were uniquely tagged with multiplex identifier (MID) sequences and 454 sequencing regions (Roche). Single round of replication pseudovirus neutralization assays and cell surface binding assays were performed as described previously (Walker, L. M., et al. Science 326, 285-289 (2009); Pantophlet, R., et al. J Virol 77, 642-658 (2003); Li, M., et al. J Virol 79, 10108-10125 (2005)). Glycan reactivities were profiled on a printed glycan microarray (version 5.0 from the Consortium for Functional Glycomics (CFG)) as described previously (Blixt, O., et al. Proc Natl Acad Sci USA 101, 17033-17038 (2004)).

Antibodies and Antigens

The following antibodies and reagents were procured by the IAVI Neutralizing Antibody Consortium: antibody 2G12 (Polymun Scientific, Vienna, Austria), antibody F425/b4E8 (provided by Lisa Cavacini, Beth Israel Deaconess Medical Center, Boston, Mass.), soluble CD4 (Progenics, Tarrytown, N.Y.), HxB2 gp120, SF162 gp120, BaL gp120, JR-FL gp120, JR-CSF gp120 and YU2 gp120 (provided by Guillaume Stewart-Jones, Oxford University). Purified ADA gp120 was produced in the laboratory of Robert Doms, University of Pennsylvania. Fab X5 was expressed in *E. coli* and purified using an anti-human Fab specific affinity column. Deglycosylated gp120 JRFL was expressed in HEK 293S GnTI$^{-/-}$ cells and treated with Endo H (Roche).

Donors

The donors identified for this study were selected from the IAVI sponsored study, Protocol G (Simek, M. D., et al. J Virol 83, 7337-7348 (2009)). Eligibility for enrolment into Protocol G was defined as: male or female at least 18 years of age with documented HIV infection for at least three years, clinically asymptomatic at the time of enrolment, and not currently receiving antiretroviral therapy. Selection of individuals for monoclonal antibody generation was based on a rank-order high throughput screening and analytical algorithm (Simek, M. D., et al. J Virol 83, 7337-7348 (2009)). Volunteers were identified as elite neutralizers based on broad and potent neutralizing activity against a cross-clade pseudovirus panel (Simek, M. D., et al. J Virol 83, 7337-7348 (2009)).

Isolation of MAbs

The method for isolating human MAbs from memory B cells in circulation has previously been described (Walker, L. M., et al. Science 326, 285-289 (2009)). Surface IgG$^+$ B cells seeded at near clonal density in 384-well microplates were activated in short-term culture. Supernatants were screened for neutralization activity against 2-4 pseudotyped viruses for which neutralization activity was detected at high titers in the donor serum. Heavy and light chain variable regions were isolated from B cell lysates of selected neutralizing hits by reverse transcription from RNA followed by multiplex PCR amplification using family-specific V-gene primer sets. Amplicons from each lysate were uniquely tagged with multiplex identifier (MID) sequences and 454 sequencing regions (Roche, Indianapolis, Ind.). A normalized pooling of gamma, kappa and lambda chains was performed based on agarose gel image quantitation and the pool was analysed by 454 Titanium® sequencing. Consensus sequences of the $V_H$ and $V_L$ chains were generated using the Amplicon Variant Analyzer (Roche) and assigned to specific B cell culture wells by decoding the MID tags. Selected $V_H$ and $V_L$ chains were synthesized and cloned in expression vectors with the appropriate IgG$_1$, IgG$_3$ or IgG$_4$ constant domain. Monoclonal antibodies were reconstituted by transient transfection in HEK293 cells followed by purification from serum-free culture supernatants.

TABLE 62

| Donor | Antibody | Chain | Primer | Sequence (Direction is 5'-3' for forward/sense or reverse/antisense primers) | SEQ ID NO: |
|---|---|---|---|---|---|
| 584 | PGT-141 | Heavy | Forward - VH1 | ACTATGGACTGGATTTGGAGGATC | 585 |
| 584 | PGT-142 | Heavy | Forward - VH1 | ACTATGGACTGGATTTGGAGGATC | 585 |
| 584 | PGT-143 | Heavy | Forward - VH1 | ACTATGGACTGGATTTGGAGGATC | 585 |
| 584 | PGT-144 | Heavy | Forward - VH1 | ACTATGGACTGGATTTGGAGGATC | 585 |
| 584 | PGT-145 | Heavy | Forward - VH1 | ACTATGGACTGGATTTGGAGGATC | 585 |
| 517 | PGT-121 | Heavy | Forward - VH4 | AACATGAAACACCTGTGGTTCTTCCT | 586 |
| 517 | PGT-122 | Heavy | Forward - VH4 | AACATGAAACACCTGTGGTTCTTCCT | 586 |
| 517 | PGT-123 | Heavy | Forward - VH4 | AACATGAAACACCTGTGGTTCTTCCT | 586 |
| 517 | PGT-124 | Heavy | Forward - VH4 | AACATGAAACACCTGTGGTTCTTCCT | 586 |
| 517 | PGT-133 | Heavy | Forward - VH4 | AACATGAAACACCTGTGGTTCTTCCT | 586 |

TABLE 62-continued

| Donor | Antibody | Chain | Primer | Sequence (Direction is 5'-3' for forward/sense or reverse/antisense primers) | SEQ ID NO: |
|---|---|---|---|---|---|
| 517 | PGT-134 | Heavy | Forward - VH4 | AACATGAAACACCTGTGGTTCTTCCT | 586 |
| 196 | PGT-125 | Heavy | Forward - VH4 | AACATGAAACACCTGTGGTTCTTCCT | 586 |
| 196 | PGT-126 | Heavy | Forward - VH4 | AACATGAAACACCTGTGGTTCTTCCT | 586 |
| 196 | PGT-127 | Heavy | Forward - VH4 | AACATGAAACACCTGTGGTTCTTCCT | 586 |
| 196 | PGT-128 | Heavy | Forward - VH4 | AACATGAAACACCTGTGGTTCTTCCT | 586 |
| 196 | PGT-130 | Heavy | Forward - VH4 | AACATGAAACACCTGTGGTTCTTCCT | 586 |
| 196 | PGT-131 | Heavy | Forward - VH4 | AACATGAAACACCTGTGGTTCTTCCT | 586 |
| 196 | PGT-132 | Heavy | Forward - VH4 | AACATGAAACACCTGTGGTTCTTCCT | 586 |
| 196 | PGT-135 | Heavy | Forward - VH4 | AACATGAAACACCTGTGGTTCTTCCT | 586 |
| 196 | PGT-138 | Heavy | Forward - VH4 | AACATGAAACACCTGTGGTTCTTCCT | 586 |
| 196 | PGT-139 | Heavy | Forward - VH4 | AACATGAAACACCTGTGGTTCTTCCT | 586 |
| 039 | PGT-135 | Heavy | Forward - VH4 | AACATGAAACACCTGTGGTTCTTCCT | 586 |
| 039 | PGT-136 | Heavy | Forward - VH4 | AACATGAAACACCTGTGGTTCTTCCT | 586 |
| 039 | PGT-137 | Heavy | Forward - VH4 | AACATGAAACACCTGTGGTTCTTCCT | 586 |
| 584 | PGT-141 | Heavy | Reverse | GGAAGTAGTCCTTGACCAGGCAGC | 587 |
| 584 | PGT-142 | Heavy | Reverse | GGAAGTAGTCCTTGACCAGGCAGC | 587 |
| 584 | PGT-143 | Heavy | Reverse | GGAAGTAGTCCTTGACCAGGCAGC | 587 |
| 584 | PGT-144 | Heavy | Reverse | GGAAGTAGTCCTTGACCAGGCAGC | 587 |
| 584 | PGT-145 | Heavy | Reverse | GGAAGTAGTCCTTGACCAGGCAGC | 587 |
| 517 | PGT-121 | Heavy | Reverse | GGAAGTAGTCCTTGACCAGGCAGC | 587 |
| 517 | PGT-122 | Heavy | Reverse | GGAAGTAGTCCTTGACCAGGCAGC | 587 |
| 517 | PGT-123 | Heavy | Reverse | GGAAGTAGTCCTTGACCAGGCAGC | 587 |
| 517 | PGT-124 | Heavy | Reverse | GGAAGTAGTCCTTGACCAGGCAGC | 587 |
| 517 | PGT-133 | Heavy | Reverse | GGAAGTAGTCCTTGACCAGGCAGC | 587 |
| 517 | PGT-134 | Heavy | Reverse | GGAAGTAGTCCTTGACCAGGCAGC | 587 |
| 196 | PGT-125 | Heavy | Reverse | GGAAGTAGTCCTTGACCAGGCAGC | 587 |
| 196 | PGT-126 | Heavy | Reverse | GGAAGTAGTCCTTGACCAGGCAGC | 587 |
| 196 | PGT-127 | Heavy | Reverse | GGAAGTAGTCCTTGACCAGGCAGC | 587 |
| 196 | PGT-128 | Heavy | Reverse | GGAAGTAGTCCTTGACCAGGCAGC | 587 |
| 196 | PGT-130 | Heavy | Reverse | GGAAGTAGTCCTTGACCAGGCAGC | 587 |
| 196 | PGT-131 | Heavy | Reverse | GGAAGTAGTCCTTGACCAGGCAGC | 587 |
| 196 | PGT-132 | Heavy | Reverse | GGAAGTAGTCCTTGACCAGGCAGC | 587 |
| 196 | PGT-135 | Heavy | Reverse | GGAAGTAGTCCTTGACCAGGCAGC | 587 |
| 196 | PGT-138 | Heavy | Reverse | GGAAGTAGTCCTTGACCAGGCAGC | 587 |
| 196 | PGT-139 | Heavy | Reverse | GGAAGTAGTCCTTGACCAGGCAGC | 587 |
| 039 | PGT-135 | Heavy | Reverse | GGAAGTAGTCCTTGACCAGGCAGC | 587 |
| 039 | PGT-136 | Heavy | Reverse | GGAAGTAGTCCTTGACCAGGCAGC | 587 |
| 039 | PGT-137 | Heavy | Reverse | GGAAGTAGTCCTTGACCAGGCAGC | 587 |

TABLE 62-continued

| DonorAntibody | Chain | Primer | Sequence (Direction is 5'-3' for forward/sense or reverse/antisense primers) | SEQ ID NO: |
|---|---|---|---|---|
| 584 PGT-141 | Light | Forward - VK2 | ATGAGGCTCCCTGCTCAGCT | 588 |
| 584 PGT-142 | Light | Forward - VK2 | ATGAGGCTCCCTGCTCAGCT | 588 |
| 584 PGT-143 | Light | Forward - VK2 | ATGAGGCTCCCTGCTCAGCT | 588 |
| 584 PGT-144 | Light | Forward - VK2 | ATGAGGCTCCCTGCTCAGCT | 588 |
| 584 PGT-145 | Light | Forward - VK2 | ATGAGGCTCCCTGCTCAGCT | 588 |
| 039 PGT-135 | Light | Forward - VK3 | CCCCAGCTCAGCTTCTCTTCC | 589 |
| 039 PGT-136 | Light | Forward - VK3 | CCCCAGCTCAGCTTCTCTTCC | 589 |
| 039 PGT-137 | Light | Forward - VK3 | CCCCAGCTCAGCTTCTCTTCC | 589 |
| 584 PGT-141 | Light | Reverse | CCTTGGATAGAAGTTATTCAGC | 590 |
| 584 PGT-142 | Light | Reverse | CCTTGGATAGAAGTTATTCAGC | 590 |
| 584 PGT-143 | Light | Reverse | CCTTGGATAGAAGTTATTCAGC | 590 |
| 584 PGT-144 | Light | Reverse | CCTTGGATAGAAGTTATTCAGC | 590 |
| 584 PGT-145 | Light | Reverse | CCTTGGATAGAAGTTATTCAGC | 590 |
| 039 PGT-135 | Light | Reverse | CCTTGGATAGAAGTTATTCAGC | 590 |
| 039 PGT-136 | Light | Reverse | CCTTGGATAGAAGTTATTCAGC | 590 |
| 039 PGT-137 | Light | Reverse | CCTTGGATAGAAGTTATTCAGC | 590 |
| 196 PGT-125 | Light | Forward - VL2 | CATGGCCTGGGCTCTGCT | 591 |
| 196 PGT-126 | Light | Forward - VL2 | CATGGCCTGGGCTCTGCT | 591 |
| 196 PGT-127 | Light | Forward - VL2 | CATGGCCTGGGCTCTGCT | 591 |
| 196 PGT-128 | Light | Forward - VL2 | CATGGCCTGGGCTCTGCT | 591 |
| 196 PGT-130 | Light | Forward - VL2 | CATGGCCTGGGCTCTGCT | 591 |
| 196 PGT-131 | Light | Forward - VL2 | CATGGCCTGGGCTCTGCT | 591 |
| 196 PGT-132 | Light | Forward - VL2 | CATGGCCTGGGCTCTGCT | 591 |
| 196 PGT-135 | Light | Forward - VL2 | CATGGCCTGGGCTCTGCT | 591 |
| 196 PGT-138 | Light | Forward - VL2 | CATGGCCTGGGCTCTGCT | 591 |
| 196 PGT-139 | Light | Forward - VL2 | CATGGCCTGGGCTCTGCT | 591 |
| 517 PGT-121 | Light | Forward - VL3 | CCATGGCCTGGATCCCTCT | 592 |
| 517 PGT-122 | Light | Forward - VL3 | CCATGGCCTGGATCCCTCT | 592 |
| 517 PGT-123 | Light | Forward - VL3 | CCATGGCCTGGATCCCTCT | 592 |
| 517 PGT-124 | Light | Forward - VL3 | CCATGGCCTGGATCCCTCT | 592 |
| 517 PGT-133 | Light | Forward - VL3 | CCATGGCCTGGATCCCTCT | 592 |
| 517 PGT-134 | Light | Forward - VL3 | CCATGGCCTGGATCCCTCT | 592 |
| 196 PGT-125 | Light | Reverse | CCTTCATGCGTGACCTGGCAGC | 593 |
| 196 PGT-126 | Light | Reverse | CCTTCATGCGTGACCTGGCAGC | 593 |
| 196 PGT-127 | Light | Reverse | CCTTCATGCGTGACCTGGCAGC | 593 |
| 196 PGT-128 | Light | Reverse | CCTTCATGCGTGACCTGGCAGC | 593 |
| 196 PGT-130 | Light | Reverse | CCTTCATGCGTGACCTGGCAGC | 593 |
| 196 PGT-131 | Light | Reverse | CCTTCATGCGTGACCTGGCAGC | 593 |

TABLE 62-continued

| Donor | Antibody | Chain | Primer | Sequence (Direction is 5'-3' for forward/sense or reverse/antisense primers) | SEQ ID NO: |
|---|---|---|---|---|---|
| 196 | PGT-132 | Light | Reverse | CCTTCATGCGTGACCTGGCAGC | 593 |
| 196 | PGT-135 | Light | Reverse | CCTTCATGCGTGACCTGGCAGC | 593 |
| 196 | PGT-138 | Light | Reverse | CCTTCATGCGTGACCTGGCAGC | 593 |
| 196 | PGT-139 | Light | Reverse | CCTTCATGCGTGACCTGGCAGC | 593 |
| 517 | PGT-121 | Light | Reverse | CCTTCATGCGTGACCTGGCAGC | 593 |
| 517 | PGT-122 | Light | Reverse | CCTTCATGCGTGACCTGGCAGC | 593 |
| 517 | PGT-123 | Light | Reverse | CCTTCATGCGTGACCTGGCAGC | 593 |
| 517 | PGT-124 | Light | Reverse | CCTTCATGCGTGACCTGGCAGC | 593 |
| 517 | PGT-133 | Light | Reverse | CCTTCATGCGTGACCTGGCAGC | 593 |
| 517 | PGT-134 | Light | Reverse | CCTTCATGCGTGACCTGGCAGC | 593 |

PGT Antibody Expression and Purification

Antibody genes were cloned into an expression vector and transiently expressed with the FreeStyle 293 Expression System (Invitrogen, Carlsbad, Calif.). Antibodies were purified using affinity chromatography (Protein A Sepharose Fast Flow, GE Healthcare, UK). Purity and integrity were checked with SDS-PAGE.

Neutralization Assays

Neutralization by monoclonal antibodies and donor sera was performed by Monogram Biosciences using a single round of replication pseudovirus assay as previously described (Richman, D. D.,et al. Proc Natl Acad Sci USA 100, 4144-4149 (2003)). Briefly, pseudoviruses capable of a single round of infection were produced by co-transfection of HEK293 cells with a subgenomic plasmid, pHIV-1lucu3, that incorporates a firefly luciferase indicator gene and a second plasmid, pCXAS that expressed HIV-1 Env libraries or clones. Following transfection, pseudoviruses were harvested and used to infect U87 cell lines expressing co-receptors CCR5 or CXCR4. Pseudovirus neutralization assays using HIV-1$_{JR\text{-}CSF}$ alanine mutants are fully described elsewhere (Walker, L. M., et al. Science 326, 285-289 (2009)). Neutralization activity of MAbs against HIV-1$_{JR\text{-}CSF}$ alanine mutants was measured using a TZM-BL assay, as described (Walker, L. M., et al. Science 326, 285-289 (2009)). Kifunensine-treated pseudoviruses were produced by treating 293T cells with 25 µM kifunensine on the day of transfection. Memory B cell supernatants were screened in a micro-neutralization assay against a cross-clade panel of HIV-1 isolates and SIVmac239 (negative control). This assay was based on the 96-well pseudotyped HIV-1 neutralization assay (Monogram Biosciences) and was modified for screening 15 µl of B cell culture supernatants in a 384-well format.

Cell Surface Binding Assays

Titrating amounts of antibodies were added to HIV-1 Env transfected 293T cells, incubated for 1 hr at 37° C., washed with FACS buffer, and stained with goat anti-human IgG F(ab')2 conjugated to phycoerythin (Jackson ImmunoResearch, West Grove, Pa.). Binding was analyzed using flow cytometry, and binding curves were generated by plotting the mean fluorescence intensity of antigen binding as a function of antibody concentration. For competition assays, titrating amounts of competitor antibodies were added to the cells 30 min prior to adding biotinylated PGT MAbs at a concentration required to give ECso.

ELISA Assays

For antigen-binding ELISAs, serial dilutions of MAbs were added to antigen-coated wells and binding was probed with alkaline phosphatase-conjugated goat anti-human immunoglobulin G (IgG) F(ab')2 Ab (Pierce, Rockford, Ill.). For competition ELISAs, titrating amounts of competitor MAbs were added to gp120-coated ELISA wells and incubated for 30 min prior to adding biotinylated PGT MAbs at a concentration required to give $IC_{70}$. Biotinylated PGT MAbs were detected using alkaline phosphatase conjugated streptavidin (Pierce) and visualized using p-nitrophenol phosphate substrate (Sigma, St. Louis, Mo.).

Glycan Microarray Analysis

Monoclonal antibodies were screened on a printed glycan microarray version 5.0 from the Consortium for Functional Glycomics (CFG) as described previously (Blixt, O., et al. Proc Natl Acad Sci USA 101, 17033-17038 (2004)). Antibodies were used at a concentration of 30 µg/ml and were precomplexed with 15 µg/ml secondary antibody (goat-anti-human-Fc-rPE, Jackson Immunoresearch) before addition to the slide. Complete glycan array data sets for all antibodies may be found at www.functionalglycomics.org in the CFG data archive under "cfg_rRequest_2250".

Oligomannose Dendron Synthesis

The oligomannose dendrons ($Man_4D$ and $Man_9D$) were synthesized by Cu(I) catalyzed alkyne-azide cycloaddition between azido oligomannose and the second generation of AB3 type alkynyl dendron. Detailed procedures and characterization were previously reported (Wang, S. K., et al. Proc Natl Acad Sci USA 105, 3690-3695 (2008)).

Fabrication of Gp120 Microarray

NHS-activated glass slides (Nexterion slide H, Schott North American) were printed with robotic pin (Arrayit 946) to deposit gp120 JRFL at concentrations of 750 or 250 µg/ml in printing buffer (120 mM phosphate, pH 8.5; containing 5% glycerol and 0.01% Tween 20). 12 replicates were used for each concentration. The printed slides were incubated in relative humidity 75% chamber overnight and treated with blocking solution (superblock blocking buffer in PBS, Thermo) at room temperature for 1 h. The slides were then rinsed with PBS-T (0.05% Tween 20) and PBS buffer, and centrifuged at 200 g to remove residual solution from slide surface.

Oligomannose Dendron-Gp120 Competition Assay with MAbs

Serial diluted oligomannose dendrons were mixed with MAb (40 µg/ml) in PBS-BT buffer (1% BSA and 0.05% Tween 20 in PBS). The mixtures were applied directly to each sub-array on slide. After incubation in a humidified chamber for 1 h at RT, the slides were rinsed sequentially with PBS-T and PBS buffer, and then centrifuged at 200 g. Each sub-array was then stained with Cy3 labeled goat anti-human Fc IgG (7.5 µg/ml in PBSBT) for 1 h in a humidified chamber. The slides were then rinsed sequentially with PBS-T and demonized water and centrifuged at 200 g. The fluorescence of the final arrays was imaged at 10 µm resolution (Ex: 540 nm; Em: 595 nm) with an Array-Worx microarray reader (Applied Precision).

Sequence Analysis

Germ line genes were predicted using the immunoglobulin sequence alignment tools IMGT/V-QUEST (Brochet, X., et al. Nucleic Acids Res 36, W503-508 (2008)) and SoDA2 (Munshaw, S. & Kepler, T. B. Bioinformatics 26, 867-872 (2010)). Clonally-related sequences were identified by common germ line V-genes and long stretches of identical N-nucleotides.

Statistical Analysis

Statistical analyses were done with Prism 5.0 for Mac (GraphPad, La Jolla, Calif.). Viruses that are not neutralized at an IC50 or IC90<50 µg/ml were given a value of 50 µg/ml for median calculations. For combinations of antibodies, a virus was counted as covered if at least one of the MAbs was neutralized depending on individual concentrations ($IC_{50}$). This approach does not take additivity into account and therefore underestimates the neutralization potency of antibody combinations.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

SEQUENCE LISTING (652 sequences)

SEQ ID NO: 1 - protein, 11 aa, Artificial Sequence
  Description of Artificial Sequence: Synthetic peptide
SSLTDRSHRIF

SEQ ID NO: 2 - protein, 11 aa, Artificial Sequence
  Description of Artificial Sequence: Synthetic peptide
KSLTSTRRRVF

SEQ ID NO: 3 - protein, 8 aa, Artificial Sequence
  Description of Artificial Sequence: Synthetic peptide
SYSTPRTF

SEQ ID NO: 4 - protein, 8 aa, Artificial Sequence
  Description of Artificial Sequence: Synthetic peptide
SFSTPRTF

SEQ ID NO: 5 - protein, 12 aa, Artificial Sequence
  Description of Artificial Sequence: Synthetic peptide
AWETTTTTFVFF

SEQ ID NO: 6 - protein, 28 aa, Artificial Sequence
  Description of Artificial Sequence: Synthetic peptide
EAGGPIWHDDVKYYDFNDGYYNYHYMDV

SEQ ID NO: 7 - protein, 28 aa, Artificial Sequence
  Description of Artificial Sequence: Synthetic peptide
EAGGPDYRNGYNYYDFYDGYYNYHYMDV

SEQ ID NO: 8 - protein, 15 aa, Artificial Sequence
  Description of Artificial Sequence: Synthetic peptide
DRRVVPMATDNWLDP

SEQ ID NO: 9 - protein, 15 aa, Artificial Sequence
  Description of Artificial Sequence: Synthetic peptide
DRRAVPIATDNWLDP

SEQ ID NO: 10 - protein, 13 aa, Artificial Sequence
  Description of Artificial Sequence: Synthetic peptide
GAVGADSGSWFDP

SEQ ID NO: 11 - DNA, 1461 bp, Artificial Sequence
  Description of Artificial Sequence: Synthetic polynucleotide
atggagtttgggctgagctgggttttcctcgcaactctgttaagagttgtgaagtgtcaggaacaactggtggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 12 - protein, 467 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - DNA, 708 bp, Artificial Sequence
  Description of Artificial Sequence: Synthetic polynucleotide
atggcctgggctctgctattcctcaccctcttcactcagggcacagggtcctggggccagtctgccctgactcagcctgcctccgtgtctgggtctcctggacagacgatcaccatctcctgcaatggaaccagcagtgacgttggtggatttgactctgtctcctggtaccaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 14 - protein, 216 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 15 - DNA, 1422 bp, Artificial Sequence
  Description of Artificial Sequence: Synthetic polynucleotide
atggactggatttggaggttcctctttgtggtggcagcagctacaggtgtccagtcccaggtccgcctggtacagtctgggcctgaggtgaagaagcctgggtcctcggtgacggtctcctgccaggcttctggaggcaccttcagcagttatgctttcacctgggtgcgccaggcccccggacaaggtcttgagtggttgggcatggtcaccccaatctttggtgaggccaagtactcacaaagattcgagggcagagtcaccatcaccgcggacgaatccacgagcacaacctccatagaattgagaggcctgacatccgaagacacggccatttattactgtgcgcgagatcggcgcgcggttccaattgccacggacaactggttagacccctggggccaggggaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 16 - protein, 454 aa, Artificial Sequence
  Description of Artificial Sequence: Synthetic polypeptide
QVRLVQSGPEVKKPGSSVTVSCQASGGTFSSYAFTWVRQAPGQGLEWLGMVTPIFGEAKYSQRFEGRVTITADESTSTTSIELRGLTSEDTAIYYCARDRRAVPIATDNWLDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - DNA, 711 bp, Artificial Sequence
  Description of Artificial Sequence: Synthetic polynucleotide
atggacatgagggtccccgctcagctcctggggctcctgctactctggctccgaggtgccagatgtgacatccagttgacccagtctccatcctccctgtctgcatctgttggcgacagagtctccatcacttgccgggcgagtcagaccattaacaactacttaaattggtatcaacagacacccgggaaagcccctaaactcctgatctatggtgcctccaatttgcaaaatggggtcccatcaaggttcagcggcagtggctctgggacagacttcactctcaccatcagcagtctgcaacctgaggattttgcaacttactactgtcaacagagtttcagtactccgaggaccttcggccaagggacacgactggatattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 18 - protein, 214 aa, Artificial Sequence
  Description of Artificial Sequence: Synthetic polypeptide
DIQLTQSPSSLSASVGDRVSITCRASQTINNYLNWYQQTPGKAPKLLIYGASNLQNGVPSRFSGSGSGTDFTLTISSLQPEDFATYYCQQSFSTPRTFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - DNA, 1422 bp, Artificial Sequence
  Description of Artificial Sequence: Synthetic polynucleotide
atggactggatttggaggttcctcttggtggtggcagcagctacaggtgtccagtcccaggtcctgctggtgcagtctgggactgaggtgaagaagcctgggtcctcggtgaaggtctcctgtcaggcttctggaggcgccttcagtagttatgctttcagctgggtgcgacaggcccctggacaggggcttgaatggatgggcatgatcacccctgtctttggtgagactaaatatgcaccgaggttccagggcagactcacacttaccgcggaagaatccttgagcaccacctacatggaattgagaagcctgacatctgatgacacggccttttattattgtacgagagatcggcgcgtagttccaatggccacagacaactggttagacccctggggccaggggacgctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 20 - protein, 453 aa, Artificial Sequence
  Description of Artificial Sequence: Synthetic polypeptide
QVLLVQSGTEVKKPGSSVKVSCQASGGAFSSYAFSWVRQAPGQGLEWMGMITPVFGETKYAPRFQGRLTLTAEESLSTTYMELRSLTSDDTAFYYCTRDRRVVPMATDNWLDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 21 - DNA, 711 bp, Artificial Sequence
  Description of Artificial Sequence: Synthetic polynucleotide
atggacatgagggtccccgctcagctcctggggctcctgctcctctggctccgaggtgccacatgtgacatccagttgacccagtctccatcctccctgtctgcatctgtaggagacagggtcaccgtcacttgccgggcgagtcagaccatacacacctatttaaattggtatcagcaaattccaggaaaagcccctaagctcctgatctatggtgcctccaccttgcaaagtggggtcccgtcaaggttcagtggcagtggatctgggacagatttcactctcaccatcaacagtctccaacctgaggactttgcaacttactactgtcaacagagttacagtaccccaaggaccttcggccaagggacacgactggatattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 22 - protein, 214 aa, Artificial Sequence
  Description of Artificial Sequence: Synthetic polypeptide
DIQLTQSPSSLSASVGDRVTVTCRASQTIHTYLNWYQQIPGKAPKLLIYGASTLQSGVPSRFSGSGSGTDFTLTINSLQPEDFATYYCQQSYSTPRTFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 23 - DNA, 1416 bp, Artificial Sequence
  Description of Artificial Sequence: Synthetic polynucleotide
atggactggatttggaggatcctcctcttggtggcagcagctacaggcaccctcgccgacggccacctggttcagtctggggttgaggtgaagaagactggggctacagtcaaaatctcctgcaaggtttctggatacagcttcatcgactactaccttcattgggtgcaacgggcccctggaaaaggccttgagtgggtgggacttattgatcctgaaaatggtgaggctcgatatgcagagaagttccagggcagagtcaccataatcgcggacacgtctatagatacaggctacatggaaatgaggagcctgaaatctgaggacacggccgtgtatttctgtgcagcaggtgccgtgggggctgattccgggagctggttcgacccctggggccagggaactctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 24 - protein, 452 aa, Artificial Sequence
  Description of Artificial Sequence: Synthetic polypeptide
DGHLVQSGVEVKKTGATVKISCKVSGYSFIDYYLHWVQRAPGKGLEWVGLIDPENGEARYAEKFQGRVTIIADTSIDTGYMEMRSLKSEDTAVYFCAAGAVGADSGSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - DNA, 705 bp, Artificial Sequence
  Description of Artificial Sequence: Synthetic polynucleotide
atggcctggatccctctcttcctcggcgtccttgcttactgcacagattccgtagtctcctatgaactgactcagccaccctcagtgtccgtgtccccaggacagacagccagcatcacctgttctggatctaaattgggggataaatatgtttcctggtatcaactgaggccaggccagtcccccatactggtcatgtatgaaaatgacaggcggccctccgggatccctgagcgattctccggttccaattctggcgacactgccactctgaccatcagcgggacccaggctttggatgaggctgacttctactgtcaggcgtgggagaccaccaccaccacttttgttttcttcggcggagggacccagctgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 26 - protein, 215 aa, Artificial Sequence
  Description of Artificial Sequence: Synthetic polypeptide
SYELTQPPSVSVSPGQTASITCSGSKLGDKYVSWYQLRPGQSPILVMYENDRRPSGIPERFSGSNSGDTATLTISGTQALDEADFYCQAWETTTTTFVFFGGGTQLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 27 - DNA, 1458 bp, Artificial Sequence
  Description of Artificial Sequence: Synthetic polynucleotide
atggagtttgggctgagctgggttttcctcgttgctttcttaagaggtgtccagtgtcagcgattagtggagtctgggggaggcgtggtccagcctgggtcgtccctgagactctcctgtgcagcgtccggattcgacttcagtagacaaggcatgcactgggtccgccaggctccaggccaggggctggagtgggtggcatttattaaatatgatggaagtgagaaatatcatgctgactccgtatggggccgactcagcatctccagagacaattccaaggatacgctttatctccaaatgaatagcctgagagtcgaggacacggctacatatttttgtgtgagagaggctggtgggcccgactaccgtaatgggtacaactattacgatttctatgatggttattataactaccactatatggacgtctggggcaaagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 28 - protein, 466 aa, Artificial Sequence
  Description of Artificial Sequence: Synthetic polypeptide
QRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - DNA, 708 bp, Artificial Sequence
  Description of Artificial Sequence: Synthetic polynucleotide
atggcctgggctctgcttttcctcaccctcctcactcagggcacagggtcctgggcccagtctgccctgactcagcctgcctccgtgtctgggtctcctggacagtcgatcaccatctcctgcaatggaaccagcaatgatgttggtggctatgaatctgtctcctggtaccaacaacatcccggcaaagcccccaaagtcgtgatttatgatgtcagtaaacggccctcaggggtttctaatcgcttctctggctccaagtccggcaacacggcctccctgaccatctctgggctccaggctgaggacgagggtgactattactgcaagtctctgacaagcacgagacgtcgggttttcggcactgggaccaagctgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 30 - protein, 216 aa, Artificial Sequence
  Description of Artificial Sequence: Synthetic polypeptide
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 31 - protein, 137 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 32 - protein, 110 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVL

SEQ ID NO: 33 - protein, 124 aa, Artificial Sequence
  Description of Artificial Sequence: Synthetic polypeptide
QVRLVQSGPEVKKPGSSVTVSCQASGGTFSSYAFTWVRQAPGQGLEWLGMVTPIFGEAKYSQRFEGRVTITADESTSTTSIELRGLTSEDTAIYYCARDRRAVPIATDNWLDPWGQGTLVTVSS

SEQ ID NO: 34 - protein, 107 aa, Artificial Sequence
  Description of Artificial Sequence: Synthetic polypeptide
DIQLTQSPSSLSASVGDRVSITCRASQTINNYLNWYQQTPGKAPKLLIYGASNLQNGVPSRFSGSGSGTDFTLTISSLQPEDFATYYCQQSFSTPRTFGQGTRLDIK

SEQ ID NO: 35 - protein, 124 aa, Artificial Sequence
  Description of Artificial Sequence: Synthetic polypeptide
QVLLVQSGTEVKKPGSSVKVSCQASGGAFSSYAFSWVRQAPGQGLEWMGMITPVFGETKYAPRFQGRLTLTAEESLSTTYMELRSLTSDDTAFYYCTRDRRVVPMATDNWLDPWGQGTLVTVSS

SEQ ID NO: 36 - protein, 107 aa, Artificial Sequence
  Description of Artificial Sequence: Synthetic polypeptide
DIQLTQSPSSLSASVGDRVTVTCRASQTIHTYLNWYQQIPGKAPKLLIYGASTLQSGVPSRFSGSGSGTDFTLTINSLQPEDFATYYCQQSYSTPRTFGQGTRLDIK

SEQ ID NO: 37 - protein, 122 aa, Artificial Sequence
  Description of Artificial Sequence: Synthetic polypeptide
DGHLVQSGVEVKKTGATVKISCKVSGYSFIDYYLHWVQRAPGKGLEWVGLIDPENGEARYAEKFQGRVTIIADTSIDTGYMEMRSLKSEDTAVYFCAAGAVGADSGSWFDPWGQGTLVTVSS

SEQ ID NO: 38 - protein, 109 aa, Artificial Sequence
  Description of Artificial Sequence: Synthetic polypeptide
SYELTQPPSVSVSPGQTASITCSGSKLGDKYVSWYQLRPGQSPILVMYENDRRPSGIPERFSGSNSGDTATLTISGTQALDEADFYCQAWETTTTTFVFFGGGTQLTVL

SEQ ID NO: 39 - protein, 136 aa, Artificial Sequence
  Description of Artificial Sequence: Synthetic polypeptide
QRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSS

SEQ ID NO: 40 - protein, 110 aa, Artificial Sequence
  Description of Artificial Sequence: Synthetic polypeptide
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVL

SEQ ID NO: 41 - protein, 10 aa, Artificial Sequence
  Description of Artificial Sequence: Synthetic peptide
SSLTDRSHRI

SEQ ID NO: 42 - protein, 9 aa, Artificial Sequence
  Description of Artificial Sequence: Synthetic peptide
QQSFSTPRT

SEQ ID NO: 43 - protein, 9 aa, Artificial Sequence
  Description of Artificial Sequence: Synthetic peptide
QQSYSTPRT

SEQ ID NO: 44 - protein, 12 aa, Artificial Sequence
  Description of Artificial Sequence: Synthetic peptide
QAWETTTTTFVF

SEQ ID NO: 45 - protein, 10 aa, Artificial Sequence
  Description of Artificial Sequence: Synthetic peptide
KSLTSTRRRV

SEQ ID NO: 46 - DNA, 1461 bp, Artificial Sequence
  Description of Artificial Sequence: Synthetic polynucleotide
atggagtttgggctgagctgggttttcctcgcaactctgttaagagttgtgaagtgtcacgaacaactggtggaggccgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgagagtcgaagacacggctatgttcttctgtgcgagagaggccggtgggccaatctggcatgacgacgtcaaatattacgattttaatgacggctactacaactatcactacatggacgtctggggcaaggggaccaaggtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 47 - protein, 467 aa, Artificial Sequence
  Description of Artificial Sequence: Synthetic polypeptide
HEQLVEAGGGVVQPGGSLRLSCLASGFTFHKYGMHWVRQAPGKGLEWVALISDDGMRKYHSDSMWGRVTISRDNSKNTLYLQFSSLRVEDTAMFFCAREAGGPIWHDDVKYYDFNDGYYNYHYMDVWGKGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 137 aa, Artificial Sequence
  Description of Artificial Sequence: Synthetic polypeptide
HEQLVEAGGGVVQPGGSLRLSCLASGFTFHKYGMHWVRQAPGKGLEWVALISDDGMRKYHSDSMWGRVTISRDNSKNTLYLQFSSLRVEDTAMFFCAREAGGPIWHDDVKYYDFNDGYYNYHYMDVWGKGTKVTVSS

SEQ ID NO: 49 - DNA, 707 bp, Artificial Sequence
  Description of Artificial Sequence: Synthetic polynucleotide
atggcctgggcttgctattcctcaccctcttcactcagggcacagggtcctggggccagtctgccctgactcagcctgcctccgtgtctgggtctcctggacagacgatcaccatctcctgcaatggaaccagccgtgacgttggtggatttgactctgtctcctggtatcaacaatccccagggaaagcccccaaagtcatggtttttgatgtcagtcatcggccctcaggtatgtctaatcgcttctctggctccaagtccggcaacacggcctccctgaccatttctgggctccacattgaggacgagggcgattatttctgctcttcattgacagacagaagccatcgcatattcggcggcgggaccaagctgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 50 - protein, 216 aa, Artificial Sequence
  Description of Artificial Sequence: Synthetic polypeptide
QSALTQPASVSGSPGQTITISCNGTSRDVGGFDSVSWYQQSPGKAPKVMVFDVSHRPSGMSNRFSGSKSGNTASLTISGLHIEDEGDYFCSSLTDRSHRIFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 51 - protein, 110 aa, Artificial Sequence
  Description of Artificial Sequence: Synthetic polypeptide
QSALTQPASVSGSPGQTITISCNGTSRDVGGFDSVSWYQQSPGKAPKVMVFDVSHRPSGMSNRFSGSKSGNTASLTISGLHIEDEGDYFCSSLTDRSHRIFGGGTKLTVL

SEQ ID NO: 52 - DNA, 1460 bp, Artificial Sequence
  Description of Artificial Sequence: Synthetic polynucleotide
atggagtttggctgagctgggttttcctcgcaactctgttaagagttgtgaagtgtcaggaaaaactggtggagtctgggggaggcgtggtccagccgggggggtccctgagactctcctgtttagcgtctggattcacctttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactttatatctgcaattcagcagcctgaaagtcgaagacacggctatgttcttctgtgcgagagaggctggtgggccaatctggcatgacgacgtcaaatattacgattttaatgacggctactacaattaccactacatggacgtctggggcaaggggaccattgtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 53 - protein, 467 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTIVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 137 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTIVTVSS

SEQ ID NO: 55 - DNA, 707 bp, Artificial Sequence
  Description of Artificial Sequence: Synthetic polynucleotide
atggcctgggcttgctattcctcaccctcttcactcagggcacagggtcctggggccagtctgccctgactcagcctgcctccgtgtctgggtctcctggacagacgatcaccatctcctgcaatggaaccagaagtgacgttggtggatttgactctgtctcctggtaccaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 56 - protein, 216 aa, Artificial Sequence
  Description of Artificial Sequence: Synthetic polypeptide
QSALTQPASVSGSPGQTITISCNGTRSDVGGFDSVSWYQQSPGKAPKVMVFDVSHRPSGISNRFSGSKSGNTASLTISGLHIEDEGDYFCSSLTDRSHRIFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 57 - protein, 110 aa, Artificial Sequence
  Description of Artificial Sequence: Synthetic polypeptide
QSALTQPASVSGSPGQTITISCNGTRSDVGGFDSVSWYQQSPGKAPKVMVFDVSHRPSGISNRFSGSKSGNTASLTISGLHIEDEGDYFCSSLTDRSHRIFGGGTKVTVL

SEQ ID NO: 58 - DNA, 1461 bp, Artificial Sequence
  Description of Artificial Sequence: Synthetic polynucleotide
atggagtttgggctgagctgggttttcctcgcaactctgttaagagttgtgaagtgtcaggaacaactgttggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcaaactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 59 - protein, 467 aa, Artificial Sequence
  Description of Artificial Sequence: Synthetic polypeptide
QEQLLESGGGVVQPGGSLRLSCLASGFTFHKYGMHWVRQAPGKGLEWVALISDDGMRKYHSNSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 137 aa, Artificial Sequence
  Description of Artificial Sequence: Synthetic polypeptide
QEQLLESGGGVVQPGGSLRLSCLASGFTFHKYGMHWVRQAPGKGLEWVALISDDGMRKYHSNSMWGRVTISRDNSKNTLYLQFSSLKVEDTAMFFCAREAGGPIWHDDVKYYDFNDGYYNYHYMDVWGKGTTVTVSS

SEQ ID NO: 61 - DNA, 708 bp, Artificial Sequence
  Description of Artificial Sequence: Synthetic polynucleotide
atggcctgggctctgctattcctcaccctcttcactcagggcacagggtcccggggccagtctgccctgactcagcctgcctccgtgtctgggtctcctggacagacgatcaccatctcctgcaatggaaccagcagtgacgttggtggatttgactctgtctcctggtatcaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 62 - DNA, 1446 bp, Artificial Sequence
  Description of Artificial Sequence: Synthetic polynucleotide
atgaaacacctgtggttcttccttctcctggtggcagctcccagatgggtcctgtcacagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 63 - DNA, 396 bp, Artificial Sequence
  Description of Artificial Sequence: Synthetic polynucleotide
cagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacagcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctca

SEQ ID NO: 64 - DNA, 1460 bp, Artificial Sequence
  Description of Artificial Sequence: Synthetic polynucleotide
atggagtttggctgagctgggttttcctcgcaactctgttaagagttgtgaagtgtcaggaacaactggtggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 65 - protein, 467 aa, Artificial Sequence; identical to SEQ ID NO: 12
  Description of Artificial Sequence: Synthetic polypeptide

SEQ ID NO: 66 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - DNA, 708 bp, Artificial Sequence
  Description of Artificial Sequence: Synthetic polynucleotide
atggcctgggctctgctattcgtcaccctcctcactcagggcacagggtcctggggccagtctgccctgactcagcctgcctccgtgtctgggtctcctggacagacgatcaccatctcctgcaatggaaccagcagtgacgttggtggatttgactctgtctcctggtatcaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 68 - DNA, 15 bp, Artificial Sequence
  Description of Artificial Sequence: Synthetic oligonucleotide
aaatatggcatgcac

SEQ ID NO: 69 - DNA, 21 bp, Artificial Sequence
  Description of Artificial Sequence: Synthetic oligonucleotide
tctggattcacgtttcacaaa

SEQ ID NO: 70 - DNA, 21 bp, Artificial Sequence
  Description of Artificial Sequence: Synthetic oligonucleotide
tctggattcacctttcacaaa

SEQ ID NO: 71 - DNA, 21 bp, Artificial Sequence
  Description of Artificial Sequence: Synthetic oligonucleotide
tctggattcacstttcacaaa

SEQ ID NO: 72 - DNA, 51 bp, Artificial Sequence
  Description of Artificial Sequence: Synthetic oligonucleotide
ctcatctcagatgacggaatgaggaaatatcattcagactccatgtggggc

SEQ ID NO: 73 - DNA, 51 bp, Artificial Sequence
  Description of Artificial Sequence: Synthetic oligonucleotide
ctcatctcagatgacggaatgaggaaatatcattcaaactccatgtggggc

SEQ ID NO: 74 - DNA, 51 bp, Artificial Sequence
  Description of Artificial Sequence: Synthetic oligonucleotide
ctcatctcagatgacggaatgaggaaatatcattcaractccatgtggggc

SEQ ID NO: 75 - DNA, 84 bp, Artificial Sequence
  Description of Artificial Sequence: Synthetic oligonucleotide
gaggctggtgggccaatctggcatgacgacgtcaaatattacgattttaatgacggctactacaactaccactacatggacgtc

SEQ ID NO: 76 - DNA, 84 bp, Artificial Sequence
  Description of Artificial Sequence: Synthetic oligonucleotide
gaggcbggtgggccaatctggcatgacgacgtcaaatattacgattttaatgacggctactacaactatcactacatggacgtc

SEQ ID NO: 77 - DNA, 84 bp, Artificial Sequence
  Description of Artificial Sequence: Synthetic oligonucleotide
gaggccggtgggccaatctggcatgacgacgtcaaatattacgattttaatgacggctactacaactatcactacatggacgtc

SEQ ID NO: 78 - DNA, 84 bp, Artificial Sequence
  Description of Artificial Sequence: Synthetic oligonucleotide
gaggcgggtgggccaatctggcatgacgacgtcaaatattacgattttaatgacggctactacaactatcactacatggacgtc

SEQ ID NO: 79 - protein, 132 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 80 - DNA, 42 bp, Artificial Sequence
  Description of Artificial Sequence: Synthetic oligonucleotide
aatggaaccagcagtgacgttggtggatttgactctgtctcc

SEQ ID NO: 81 - DNA, 42 bp, Artificial Sequence
  Description of Artificial Sequence: Synthetic oligonucleotide
aatggaaccagmmgtgacgttggtggatttgactctgtctcc

SEQ ID NO: 82 - DNA, 42 bp, Artificial Sequence
  Description of Artificial Sequence: Synthetic oligonucleotide
aatggaaccagaagtgacgttggtggatttgactctgtctcc

SEQ ID NO: 83 - DNA, 42 bp, Artificial Sequence
  Description of Artificial Sequence: Synthetic oligonucleotide
aatggaaccagccgtgacgttggtggatttgactctgtctcc

SEQ ID NO: 84 - DNA, 21 bp, Artificial Sequence
  Description of Artificial Sequence: Synthetic oligonucleotide
gatgtcagtcatcggccctca

SEQ ID NO: 85 - DNA, 30 bp, Artificial Sequence
  Description of Artificial Sequence: Synthetic oligonucleotide
tcttcactgacagacagaagccatcgcata

SEQ ID NO: 86 - DNA, 30 bp, Artificial Sequence
  Description of Artificial Sequence: Synthetic oligonucleotide
tcttcattgacagacagaagccatcgcata

SEQ ID NO: 87 - DNA, 30 bp, Artificial Sequence
  Description of Artificial Sequence: Synthetic oligonucleotide
tcttcaytgacagacagaagccatcgcata

SEQ ID NO: 88 - protein, 5 aa, Artificial Sequence
  Description of Artificial Sequence: Synthetic peptide
KYGMH

SEQ ID NO: 89 - protein, 17 aa, Artificial Sequence
  Description of Artificial Sequence: Synthetic peptide
LISDDGMRKYHSDSMWG

SEQ ID NO: 90 - protein, 5 aa, Artificial Sequence
  Description of Artificial Sequence: Synthetic peptide
DSYWS

SEQ ID NO: 91 - protein, 17 aa, Artificial Sequence
  Description of Artificial Sequence: Synthetic peptide
  MOD_RES (13)..(13): Asp, Asn or an amino acid with similar physical properties to either Asp or Asn
LISDDGMRKYHSXSMWG

SEQ ID NO: 92 - protein, 14 aa, Artificial Sequence
  Description of Artificial Sequence: Synthetic peptide
NGTRSDVGGFDSVS

SEQ ID NO: 93 - protein, 14 aa, Artificial Sequence
  Description of Artificial Sequence: Synthetic peptide
NGTSRDVGGFDSVS

SEQ ID NO: 94 - protein, 14 aa, Artificial Sequence
  Description of Artificial Sequence: Synthetic peptide
  MOD_RES (4)..(5): Ser, Arg or an amino acid with similar physical properties to either Ser or Arg
NGTXXDVGGFDSVS

SEQ ID NO: 95 - protein, 7 aa, Artificial Sequence
  Description of Artificial Sequence: Synthetic peptide
DVSHRPS

SEQ ID NO: 96 - protein, 110 aa, Artificial Sequence
  Description of Artificial Sequence: Synthetic polypeptide
QSALTQPASVSGSPGQTITISCNGTRSDVGGFDSVSWYQQSPGRAPKVMVFDVSHRPSGISNRFSGSKSGNTASLTISGLHIEDEGDYFCSSLTDRSHRIFGGGTKLTVL

SEQ ID NO: 97 - protein, 14 aa, Artificial Sequence
  Description of Artificial Sequence: Synthetic peptide
NGTSSDVGGFDSVS

SEQ ID NO: 98 - protein, 17 aa, Artificial Sequence
  Description of Artificial Sequence: Synthetic peptide
LISDDGMRKYHSNSMWG

SEQ ID NO: 99 - DNA, 411 bp, Artificial Sequence
  Description of Artificial Sequence: Synthetic polynucleotide
caggaacaactggtggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcgagc

SEQ ID NO: 100 - DNA, 330 bp, Artificial Sequence
  Description of Artificial Sequence: Synthetic polynucleotide
cagtctgccctgactcagcctgcctccgtgtctgggtctcctggacagacgatcaccatctcctgcaatggaaccagcagtgacgttggtggatttgactctgtctcctggtaccaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccgttcta

SEQ ID NO: 101 - DNA, 372 bp, Artificial Sequence
  Description of Artificial Sequence: Synthetic polynucleotide
caggtccgcctggtacagtctgggcctgaggtgaagaagcctgggtcctcggtgacggtctcctgccaggcttctggaggcaccttcagcagttatgctttcacctgggtgcgccaggcccccggacaaggtcttgagtggttgggcatggtcaccccaatctttggtgaggccaagtactcacaaagattcgagggcagagtcaccatcaccgcggacgaatccacgagcacaacctccatagaattgagaggcctgacatccgaagacacggccatttattactgtgcgcgagatcggcgcgcggttccaattgccacggacaactggttagacccctggggccaggggaccctggtcaccgtctcgagc

SEQ ID NO: 102 - protein, 6 aa, Artificial Sequence
  Description of Artificial Sequence: Synthetic peptide
GYSFID

SEQ ID NO: 103 - protein, 10 aa, Artificial Sequence
  Description of Artificial Sequence: Synthetic peptide
LIDPENGEAR

SEQ ID NO: 104 - protein, 5 aa, Artificial Sequence
  Description of Artificial Sequence: Synthetic peptide
SYAFT

SEQ ID NO: 105 - protein, 17 aa, Artificial Sequence
  Description of Artificial Sequence: Synthetic peptide
MVTPIFGEAKYSQRFEG

SEQ ID NO: 106 - DNA, 321 bp, Artificial Sequence
  Description of Artificial Sequence: Synthetic polynucleotide
gacatccagttgacccagtctccatcctccctgtctgcatctgttggcgacagagtctccatcacttgccgggcgagtcagaccattaacaactacttaaattggtatcaacagacacccgggaaagcccctaaactcctgatctatggtgcctccaatttgcaaaatggggtcccatcaaggttcagcggcagtggctctgggacagacttcactctcaccatcagcagtctgcaacctgaggattttgcaacttactactgtcaacagagtttcagtactccgaggaccttcggccaagggacacgactggatattaaa

SEQ ID NO: 107 - protein, 11 aa, Artificial Sequence
  Description of Artificial Sequence: Synthetic peptide
RASQTINNYLN

SEQ ID NO: 108 - protein, 7 aa, Artificial Sequence
  Description of Artificial Sequence: Synthetic peptide
GASNLQN

SEQ ID NO: 109 - DNA, 372 bp, Artificial Sequence
  Description of Artificial Sequence: Synthetic polynucleotide
caggtcctgctggtgcagtctgggactgaggtgaagaagcctgggtcctcggtgaaggtctcctgtcaggcttctggaggcgccttcagtagttatgctttcagctgggtgcgacaggcccctggacaggggcttgaatggatgggcatgatcacccctgtctttggtgagactaaatatgcaccgaggttccagggcagactcacacttaccgcggaagaatccttgagcaccacctacatggaattgagaagcctgacatctgatgacacggccttttattattgtacgagagatcggcgcgtagttccaatggccacagacaactggttagacccctggggccaggggacgctggtcaccgtctcgagc

SEQ ID NO: 110 - protein, 5 aa, Artificial Sequence
  Description of Artificial Sequence: Synthetic peptide
SYAFS

SEQ ID NO: 111 - protein, 17 aa, Artificial Sequence
  Description of Artificial Sequence: Synthetic peptide
MITPVFGETKYAPRFQG

SEQ ID NO: 112 - DNA, 321 bp, Artificial Sequence
  Description of Artificial Sequence: Synthetic polynucleotide
gacatccagttgacccagtctccatcctccctgtctgcatctgtaggagacagggtcaccgtcacttgccgggcgagtcagaccatacacacctatttaaattggtatcagcaaattccaggaaaagcccctaagctcctgatctatggtgcctccaccttgcaaagtggggtcccgtcaaggttcagtggcagtggatctgggacagatttcactctcaccatcaacagtctccaacctgaggactttgcaacttactactgtcaacagagttacagtaccccaaggaccttcggccaagggacacgactggatattaaa

SEQ ID NO: 113 - protein, 11 aa, Artificial Sequence
  Description of Artificial Sequence: Synthetic peptide
RASQTIHTYLN

SEQ ID NO: 114 - protein, 7 aa, Artificial Sequence
  Description of Artificial Sequence: Synthetic peptide
GASTLQS

SEQ ID NO: 115 - DNA, 366 bp, Artificial Sequence
  Description of Artificial Sequence: Synthetic polynucleotide
gacggccacctggttcagtctggggttgaggtgaagaagactggggctacagtcaaaatctcctgcaaggtttctggatacagcttcatcgactactaccttcattgggtgcaacgggcccctggaaaaggccttgagtgggtgggacttattgatcctgaaaatggtgaggctcgatatgcagagaagttccagggcagagtcaccataatcgcggacacgtctatagatacaggctacatggaaatgaggagcctgaaatctgaggacacggccgtgtatttctgtgcagcaggtgccgtgggggctgattccgggagctggttcgacccctggggccagggaactctggtcaccgtctcgagc

SEQ ID NO: 116 - protein, 5 aa, Artificial Sequence
  Description of Artificial Sequence: Synthetic peptide
DYYLH

SEQ ID NO: 117 - protein, 17 aa, Artificial Sequence
  Description of Artificial Sequence: Synthetic peptide
LIDPENGEARYAEKFQG

SEQ ID NO: 118 - protein, 6 aa, Artificial Sequence
  Description of Artificial Sequence: Synthetic peptide
GFDFSR

SEQ ID NO: 119 - DNA, 327 bp, Artificial Sequence
  Description of Artificial Sequence: Synthetic polynucleotide
tcctatgaactgactcagccaccctcagtgtccgtgtccccaggacagacagccagcatcacctgttctggatctaaattgggggataaatatgtttcctggtatcaactgaggccaggccagtcccccatactggtcatgtatgaaaatgacaggcggccctccgggatccctgagcgattctccggttccaattctggcgacactgccactctgaccatcagcgggacccaggctttggatgaggctgacttctactgtcaggcgtgggagaccaccaccaccacttttgttttcttcggcggagggacccagctgaccgttcta

SEQ ID NO: 120 - protein, 11 aa, Artificial Sequence
  Description of Artificial Sequence: Synthetic peptide
SGSKLGDKYVS

SEQ ID NO: 121 - protein, 7 aa, Artificial Sequence
  Description of Artificial Sequence: Synthetic peptide
ENDRRPS

SEQ ID NO: 122 - DNA, 408 bp, Artificial Sequence
  Description of Artificial Sequence: Synthetic polynucleotide
cagcgattagtggagtctgggggaggcgtggtccagcctgggtcgtccctgagactctcctgtgcagcgtccggattcgacttcagtagacaaggcatgcactgggtccgccaggctccaggccaggggctggagtgggtggcatttattaaatatgatggaagtgagaaatatcatgctgactccgtatggggccgactcagcatctccagagacaattccaaggatacgctttatctccaaatgaatagcctgagagtcgaggacacggctacatatttttgtgtgagagaggctggtgggcccgactaccgtaatgggtacaactattacgatttctatgatggttattataactaccactatatggacgtctggggcaaagggaccacggtcaccgtctcgagc

SEQ ID NO: 123 - protein, 5 aa, Artificial Sequence
  Description of Artificial Sequence: Synthetic peptide
RQGMH

SEQ ID NO: 124 - protein, 17 aa, Artificial Sequence
  Description of Artificial Sequence: Synthetic peptide
FIKYDGSEKYHADSVWG

SEQ ID NO: 125 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcaatggaaccagcaatgatgttggtggctatgaatctgtctcctggtaccaacaacatcccggcaaagcccccaaagtcgtgatttatgatgtcagtaaacggccctcaggggtttctaatcgcttctctggctccaagtccggcaacacggcctccctgaccatctctgggctccaggctgaggacgagggtgactattactgcaagtctctgacaagcacgagacgtcgggttttcggcactgggaccaagctgaccgttcta

SEQ ID NO: 126 - protein, 14 aa, Artificial Sequence
  Description of Artificial Sequence: Synthetic peptide
NGTSNDVGGYESVS

SEQ ID NO: 127 - protein, 7 aa, Artificial Sequence
  Description of Artificial Sequence: Synthetic peptide
DVSKRPS

SEQ ID NO: 128 - DNA, 411 bp, Artificial Sequence
  Description of Artificial Sequence: Synthetic polynucleotide
caggaaaaactggtggagtctgggggaggcgtggtccagccgggggggtccctgagactctcctgtttagcgtctggattcacctttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctatatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcctca

SEQ ID NO: 129 - DNA, 330 bp, Artificial Sequence
  Description of Artificial Sequence: Synthetic polynucleotide
cagtctgccctgactcagcctgcctccgtgtctgggtctcctggacagacgatcaccatctcctgcaatggaaccagaagtgacgttggtggatttgactctgtctcctggtaccaacaatccccagggagagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaagctgaccgttcta

SEQ ID NO: 130 - DNA, 411 bp, Artificial Sequence
  Description of Artificial Sequence: Synthetic polynucleotide
cacgaacaactggtggaggccgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgagagtcgaagacacggctatgttcttctgtgcgagagaggccggtgggccaatctggcatgacgacgtcaaatattacgattttaatgacggctactacaactatcactacatggacgtctggggcaaggggaccaaggtcaccgtctcctca

SEQ ID NO: 131 - DNA, 330 bp, Artificial Sequence
  Description of Artificial Sequence: Synthetic polynucleotide
cagtctgccctgactcagcctgcctccgtgtctgggtctcctggacagacgatcaccatctcctgcaatggaaccagccgtgacgttggtggatttgactctgtctcctggtatcaacaatccccagggaaagcccccaaagtcatggtttttgatgtcagtcatcggccctcaggtatgtctaatcgcttctctggctccaagtccggcaacacggcctccctgaccatttctgggctccacattgaggacgagggcgattatttctgctcttcattgacagacagaagccatcgcatattcggcggcgggaccaagctgaccgttcta

SEQ ID NO: 132 - DNA, 411 bp, Artificial Sequence
  Description of Artificial Sequence: Synthetic polynucleotide
caggaaaaactggtggagtctgggggaggcgtggtccagccgggggggtccctgagactctcctgtttagcgtctggattcacctttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactttatatctgcaattcagcagcctgaaagtcgaagacacggctatgttcttctgtgcgagagaggctggtgggccaatctggcatgacgacgtcaaatattacgattttaatgacggctactacaattaccactacatggacgtctggggcaaggggaccattgtcaccgtctcctca

SEQ ID NO: 133 - DNA, 330 bp, Artificial Sequence
  Description of Artificial Sequence: Synthetic polynucleotide
cagtctgccctgactcagcctgcctccgtgtctgggtctcctggacagacgatcaccatctcctgcaatggaaccagaagtgacgttggtggatttgactctgtctcctggtaccaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccgttcta

SEQ ID NO: 134 - DNA, 411 bp, Artificial Sequence
  Description of Artificial Sequence: Synthetic polynucleotide
caggaacaactgttggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcaaactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcctca

SEQ ID NO: 135 - DNA, 330 bp, Artificial Sequence
  Description of Artificial Sequence: Synthetic polynucleotide
cagtctgccctgactcagcctgcctccgtgtctgggtctcctggacagacgatcaccatctcctgcaatggaaccagcagtgacgttggtggatttgactctgtctcctggtatcaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccgttcta

SEQ ID NO: 136 - DNA, 411 bp, Artificial Sequence
  Description of Artificial Sequence: Synthetic polynucleotide
caggaacaactggtggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcctca

SEQ ID NO: 137 - DNA, 330 bp, Artificial Sequence; identical to SEQ ID NO: 135
  Description of Artificial Sequence: Synthetic polynucleotide

SEQ ID NO: 138 - DNA, 1461 bp, Artificial Sequence
  Description of Artificial Sequence: Synthetic polynucleotide
atggagtttgggctgagctgggttttcctcgcaactctgttaagagttgtgaagtgtcaggaaaaactggtggagtctgggggaggcgtggtccagccgggggggtccctgagactctcctgtttagcgtctggattcacctttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctatatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 139 - protein, 467 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 137 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 141 - DNA, 708 bp, Artificial Sequence
  Description of Artificial Sequence: Synthetic polynucleotide
atggcctgggctctgctattcctcaccctcttcactcagggcacagggtcctggggccagtctgccctgactcagcctgcctccgtgtctgggtctcctggacagacgatcaccatctcctgcaatggaaccagaagtgacgttggtggatttgactctgtctcctggtaccaacaatccccagggagagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaagctgaccgttctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 142 - protein, 216 aa, Artificial Sequence
  Description of Artificial Sequence: Synthetic polypeptide
QSALTQPASVSGSPGQTITISCNGTRSDVGGFDSVSWYQQSPGRAPKVMVFDVSHRPSGISNRFSGSKSGNTASLTISGLHIEDEGDYFCSSLTDRSHRIFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 143 - protein, 24 aa, Artificial Sequence
  Description of Artificial Sequence: Synthetic peptide
TLHGRRIYGIVAFNEWFTYFYMDV

SEQ ID NO: 144 - protein, 6 aa, Artificial Sequence
  Description of Artificial Sequence: Synthetic peptide
GASISD

SEQ ID NO: 145 - protein, 9 aa, Artificial Sequence
  Description of Artificial Sequence: Synthetic peptide
YVHKSGDTN

SEQ ID NO: 146 - DNA, 693 bp, Artificial Sequence
  Description of Artificial Sequence: Synthetic polynucleotide
atggcctggacctttctcctcctcggcctcctctctcactgcacagcctctgtgacctccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtgttaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 147 - DNA, 315 bp, Artificial Sequence
  Description of Artificial Sequence: Synthetic polynucleotide
tccgatatatctgtggccccaggagagacggccaggatttcctgtggggaaaagagccttggaagtagagctgtacaatggtatcaacacagggccggccaggccccctctttaatcatatataataatcaggaccggccctcagggatccctgagcgattctctggctcccctgactccccttttgggaccacggccaccctgaccatcaccagtgtcgaagccggggatgaggccgactattactgtcatatatgggatagtagagttcccaccaaatgggtcttcggcggagggaccacgctgaccgtgtta

SEQ ID NO: 148 - protein, 211 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 149 - protein, 105 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 150 - protein, 11 aa, Artificial Sequence
  Description of Artificial Sequence: Synthetic peptide
GEKSLGSRAVQ

SEQ ID NO: 151 - protein, 7 aa, Artificial Sequence
  Description of Artificial Sequence: Synthetic peptide
NNQDRPS

SEQ ID NO: 152 - protein, 12 aa, Artificial Sequence
  Description of Artificial Sequence: Synthetic peptide
HIWDSRVPTKWV

SEQ ID NO: 153 - DNA, 1446 bp, Artificial Sequence
  Description of Artificial Sequence: Synthetic polynucleotide
atgaaacacctgtggttcttccttctcctggtggcagctcccagatgggtcctgtcccaggttcatctgcaggagtcgggccccggactggtgaagccttcggagaccctgtccctcacgtgcaatgtgtctgggaccctcgtgcgtgataactactggagctggatcagacaacccctcgggaagcaacctgagtggattggctatgtccatgacagcggggacacgaattacaacccctccctgaagagtcgagtccacttatcgttggacaagtccaaaaacctggtgtccctgaggctgaccggcgtgaccgccgcggactcggccatatattattgcgcgacaacaaaacacgggaggaggatttatggcgtcgttgccttcaaagagtggttcacctatttctacatggacgtctggggcaaagggacttcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 154 - DNA, 396 bp, Artificial Sequence
  Description of Artificial Sequence: Synthetic polynucleotide
caggttcatctgcaggagtcgggccccggactggtgaagccttcggagaccctgtccctcacgtgcaatgtgtctgggaccctcgtgcgtgataactactggagctggatcagacaacccctcgggaagcaacctgagtggattggctatgtccatgacagcggggacacgaattacaacccctccctgaagagtcgagtccacttatcgttggacaagtccaaaaacctggtgtccctgaggctgaccggcgtgaccgccgcggactcggccatatattattgcgcgacaacaaaacacgggaggaggatttatggcgtcgttgccttcaaagagtggttcacctatttctacatggacgtctggggcaaagggacttcggtcaccgtctcctca

SEQ ID NO: 155 - protein, 481 aa, Artificial Sequence
  Description of Artificial Sequence: Synthetic polypeptide
MKHLWFFLLLVAAPRWVLSQVHLQESGPGLVKPSETLSLTCNVSGTLVRDNYWSWIRQPLGKQPEWIGYVHDSGDTNYNPSLKSRVHLSLDKSKNLVSLRLTGVTAADSAIYYCATTKHGRRIYGVVAFKEWFTYFYMDVWGKGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 132 aa, Artificial Sequence
  Description of Artificial Sequence: Synthetic polypeptide
QVHLQESGPGLVKPSETLSLTCNVSGTLVRDNYWSWIRQPLGKQPEWIGYVHDSGDTNYNPSLKSRVHLSLDKSKNLVSLRLTGVTAADSAIYYCATTKHGRRIYGVVAFKEWFTYFYMDVWGKGTSVTVSS

SEQ ID NO: 157 - protein, 16 aa, Artificial Sequence
  Description of Artificial Sequence: Synthetic peptide
YVHDSGDTNYNPSLKS

SEQ ID NO: 158 - DNA, 693 bp, Artificial Sequence
  Description of Artificial Sequence: Synthetic polynucleotide
atggcctggaccgttctcctcctcggcctcctctctcactgcacaggcgcggtgtctacctttgtgtcagtggccccaggacagacggccaggattacttgtggggaagagagccttggaagtagatctgttatttggtatcaacagaggccaggccaggccccttcattaatcatctataataataatgaccggccctcagggattcctgaccgattttctgggtcccctggctccacttttgggaccacggccaccctgaccatcaccagtgtcgaagccggggatgaggccgactattattgtcatatctgggatagtagacgaccaaccaattgggtcttcggcgaagggaccacactgatcgtgttaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 159 - DNA, 315 bp, Artificial Sequence
  Description of Artificial Sequence: Synthetic polynucleotide
acctttgtgtcagtggccccaggacagacggccaggattacttgtggggaagagagccttggaagtagatctgttatttggtatcaacagaggccaggccaggccccttcattaatcatctataataataatgaccggccctcagggattcctgaccgattttctgggtcccctggctccacttttgggaccacggccaccctgaccatcaccagtgtcgaagccggggatgaggccgactattattgtcatatctgggatagtagacgaccaaccaattgggtcttcggcgaagggaccacactgatcgtgtta

SEQ ID NO: 160 - protein, 230 aa, Artificial Sequence
  Description of Artificial Sequence: Synthetic polypeptide
MAWTVLLLGLLSHCTGAVSTFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 161 - protein, 105 aa, Artificial Sequence
  Description of Artificial Sequence: Synthetic polypeptide
TFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVL

SEQ ID NO: 162 - protein, 11 aa, Artificial Sequence
  Description of Artificial Sequence: Synthetic peptide
GEESLGSRSVI

SEQ ID NO: 163 - protein, 7 aa, Artificial Sequence
  Description of Artificial Sequence: Synthetic peptide
NNNDRPS

SEQ ID NO: 164 - protein, 12 aa, Artificial Sequence
  Description of Artificial Sequence: Synthetic peptide
HIWDSRRPTNWV

SEQ ID NO: 165 - DNA, 1446 bp, Artificial Sequence
  Description of Artificial Sequence: Synthetic polynucleotide
atgaaacacctgtggatcttccttctcctggtggcaactcccagatgggtcgagtcccagctgcacctgcaggagtcgggcccagggctggtgaagcctccggagaccctgtccctcacgtgtagtgtgtctggcgcctccatcaatgatgcctattggagttggattcggcagtccccagggaagcggcctgagtgggttggatatgtccatcacagcggtgacacaaattataatccctcactcaagaggcgcgtcacgttttcattagacacggccaagaatgaagtgtccctgaaattagtagacctgaccgctgcggactcggccacatatttttgtgcgcgagcacttcacgggaagaggatttatgggatagttgccctcggagagttgttcacctacttctacatggacgtctggggcaaggggactgcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 166 - DNA, 396 bp, Artificial Sequence
  Description of Artificial Sequence: Synthetic polynucleotide
cagctgcacctgcaggagtcgggcccagggctggtgaagcctccggagaccctgtccctcacgtgtagtgtgtctggcgcctccatcaatgatgcctattggagttggattcggcagtccccagggaagcggcctgagtgggttggatatgtccatcacagcggtgacacaaattataatccctcactcaagaggcgcgtcacgttttcattagacacggccaagaatgaagtgtccctgaaattagtagacctgaccgctgcggactcggccacatatttttgtgcgcgagcacttcacgggaagaggatttatgggatagttgccctcggagagttgttcacctacttctacatggacgtctggggcaaggggactgcggtcaccgtctcctca

SEQ ID NO: 167 - protein, 481 aa, Artificial Sequence
  Description of Artificial Sequence: Synthetic polypeptide
MKHLWIFLLLVATPRWVESQLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 132 aa, Artificial Sequence
  Description of Artificial Sequence: Synthetic polypeptide
QLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSS

SEQ ID NO: 169 - protein, 5 aa, Artificial Sequence
  Description of Artificial Sequence: Synthetic peptide
DAYWS

SEQ ID NO: 170 - protein, 16 aa, Artificial Sequence
  Description of Artificial Sequence: Synthetic peptide
YVHHSGDTNYNPSLKR

SEQ ID NO: 171 - protein, 24 aa, Artificial Sequence
  Description of Artificial Sequence: Synthetic peptide
ALHGKRIYGIVALGELFTYFYMDV

SEQ ID NO: 172 - protein, 6 aa, Artificial Sequence
  Description of Artificial Sequence: Synthetic peptide
GASIND

SEQ ID NO: 173 - protein, 9 aa, Artificial Sequence
  Description of Artificial Sequence: Synthetic peptide
YVHHSGDTN

SEQ ID NO: 174 - DNA, 693 bp, Artificial Sequence
  Description of Artificial Sequence: Synthetic polynucleotide
atggcctggaccgttctcctcctcggcctcctctctcactgcacaggctctctggcctcctctatgtccgtgtccccgggggagacggccaagatctcctgtggaaaagagagcattggtagcagagctgtgcaatggtatcagcagaagccaggccagcccccctcattgattatctataataatcaggaccgccccgcaggggtccctgagcgattctctgcctcccctgacttccgtcctgggaccacggccaccctgaccatcaccaatgtcgacgccgaggatgaggccgactattactgtcatatatatgatgctagaggtggcaccaattgggtcttcgacagagggaccacactgaccgtcttaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 175 - DNA, 315 bp, Artificial Sequence
  Description of Artificial Sequence: Synthetic polynucleotide
tcctctatgtccgtgtccccgggggagacggccaagatctcctgtggaaaagagagcattggtagcagagctgtgcaatggtatcagcagaagccaggccagcccccctcattgattatctataataatcaggaccgccccgcaggggtccctgagcgattctctgcctcccctgacttccgtcctgggaccacggccaccctgaccatcaccaatgtcgacgccgaggatgaggccgactattactgtcatatatatgatgctagaggtggcaccaattgggtcttcgacagagggaccacactgaccgtctta

SEQ ID NO: 176 - protein, 230 aa, Artificial Sequence
  Description of Artificial Sequence: Synthetic polypeptide
MAWTVLLLGLLSHCTGSLASSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 177 - protein, 105 aa, Artificial Sequence
  Description of Artificial Sequence: Synthetic polypeptide
SSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVL

SEQ ID NO: 178 - protein, 11 aa, Artificial Sequence
  Description of Artificial Sequence: Synthetic peptide
GKESIGSRAVQ

SEQ ID NO: 179 - protein, 7 aa, Artificial Sequence
  Description of Artificial Sequence: Synthetic peptide
NNQDRPA

SEQ ID NO: 180 - protein, 12 aa, Artificial Sequence
  Description of Artificial Sequence: Synthetic peptide
HIYDARGGTNWV

SEQ ID NO: 181 - DNA, 1455 bp, Artificial Sequence
  Description of Artificial Sequence: Synthetic polynucleotide
atgaaacacctgtggttcttcttcctgctggtggcggctcccagatgcgtcctgtcccagtcgcagctgcaggagtcgggcccacgactggtggaggcctcggagaccctgtcactcacgtgcaatgtgtccggcgagtccactggtgcctgtacttatttctggggctgggtccggcaggccccagggaaggggctggagtggatcgggagtttgtcccattgtcagagtttctggggttccggttggaccttccacaacccgtctctcaagagtcgactcacgatttcactcgacacgcccaagaatcaggtcttcctcaagctcacttctctgactgccgcggacacggccacttactactgtgcgcgattcgacggcgaagtcttggtctataatcattggccaaagccggcctgggtggacctctggggccgcggaataccggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 182 - DNA, 405 bp, Artificial Sequence
  Description of Artificial Sequence: Synthetic polynucleotide
cagtcgcagctgcaggagtcgggcccacgactggtggaggcctcggagaccctgtcactcacgtgcaatgtgtccggcgagtccactggtgcctgtacttatttctggggctgggtccggcaggccccagggaaggggctggagtggatcgggagtttgtcccattgtcagagtttctggggttccggttggaccttccacaacccgtctctcaagagtcgactcacgatttcactcgacacgcccaagaatcaggtcttcctcaagctcacttctctgactgccgcggacacggccacttactactgtgcgcgattcgacggcgaagtcttggtctataatcattggccaaagccggcctgggtggacctctggggccgcggaataccggtcaccgtctcctca

SEQ ID NO: 183 - protein, 484 aa, Artificial Sequence
  Description of Artificial Sequence: Synthetic polypeptide
MKHLWFFFLLVAAPRCVLSQSQLQESGPRLVEASETLSLTCNVSGESTGACTYFWGWVRQAPGKGLEWIGSLSHCQSFWGSGWTFHNPSLKSRLTISLDTPKNQVFLKLTSLTAADTATYYCARFDGEVLVYNHWPKPAWVDLWGRGIPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 135 aa, Artificial Sequence
  Description of Artificial Sequence: Synthetic polypeptide
QSQLQESGPRLVEASETLSLTCNVSGESTGACTYFWGWVRQAPGKGLEWIGSLSHCQSFWGSGWTFHNPSLKSRLTISLDTPKNQVFLKLTSLTAADTATYYCARFDGEVLVYNHWPKPAWVDLWGRGIPVTVSS

SEQ ID NO: 185 - protein, 7 aa, Artificial Sequence
  Description of Artificial Sequence: Synthetic peptide
ACTYFWG

SEQ ID NO: 186 - protein, 22 aa, Artificial Sequence
  Description of Artificial Sequence: Synthetic peptide
SLSHCQSFWGSGWTFHNPSLKS

SEQ ID NO: 187 - protein, 19 aa, Artificial Sequence
  Description of Artificial Sequence: Synthetic peptide
FDGEVLVYNHWPKPAWVDL

SEQ ID NO: 188 - protein, 8 aa, Artificial Sequence
  Description of Artificial Sequence: Synthetic peptide
GESTGACT

SEQ ID NO: 189 - protein, 15 aa, Artificial Sequence
  Description of Artificial Sequence: Synthetic peptide
SLSHCQSFWGSGWTF

SEQ ID NO: 190 - DNA, 693 bp, Artificial Sequence
  Description of Artificial Sequence: Synthetic polynucleotide
atggcctgggctctgctcctcctcaccctcctcactcagggcacaggggcctgggcccagtctgccctgactcagcctccctccgcgtccgggtctcctggacagtcaatcaccatctcctgcaatggaaccgccactaactttgtctcctggtaccaacaattcccagacaaggcccccaaactcatcatttttggggtcgataagcgcccccccggtgtccccgatcgtttctctggctcccggtctggcacgacggcctcccttaccgtctcccgactccagactgacgatgaggctgtctattattgcggttcacttgtcggcaactgggatgtgattttcggcggagggaccaccttgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 191 - DNA, 315 bp, Artificial Sequence
  Description of Artificial Sequence: Synthetic polynucleotide
cagtctgccctgactcagcctccctccgcgtccgggtctcctggacagtcaatcaccatctcctgcaatggaaccgccactaactttgtctcctggtaccaacaattcccagacaaggcccccaaactcatcatttttggggtcgataagcgcccccccggtgtccccgatcgtttctctggctcccggtctggcacgacggcctcccttaccgtctcccgactccagactgacgatgaggctgtctattattgcggttcacttgtcggcaactgggatgtgattttcggcggagggaccaccttgaccgtccta

SEQ ID NO: 192 - protein, 230 aa, Artificial Sequence
  Description of Artificial Sequence: Synthetic polypeptide
MAWALLLLTLLTQGTGAWAQSALTQPPSASGSPGQSITISCNGTATNFVSWYQQFPDKAPKLIIFGVDKRPPGVPDRFSGSRSGTTASLTVSRLQTDDEAVYYCGSLVGNWDVIFGGGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 193 - protein, 105 aa, Artificial Sequence
  Description of Artificial Sequence: Synthetic polypeptide
QSALTQPPSASGSPGQSITISCNGTATNFVSWYQQFPDKAPKLIIFGVDKRPPGVPDRFSGSRSGTTASLTVSRLQTDDEAVYYCGSLVGNWDVIFGGGTTLTVL

SEQ ID NO: 194 - protein, 9 aa, Artificial Sequence
  Description of Artificial Sequence: Synthetic peptide
NGTATNFVS

SEQ ID NO: 195 - protein, 7 aa, Artificial Sequence
  Description of Artificial Sequence: Synthetic peptide
GVDKRPP

SEQ ID NO: 196 - protein, 10 aa, Artificial Sequence
  Description of Artificial Sequence: Synthetic peptide
GSLVGNWDVI

SEQ ID NO: 197 - DNA, 1455 bp, Artificial Sequence
  Description of Artificial Sequence: Synthetic polynucleotide
atgaaacacctgtggttcttcctcctgctggtggcggctcccagatgggtcctgtcccagccgcagctgcaggagtcggggccaggactggtggaggcttcggagaccctgtccctcacctgcactgtgtccggcgactccactgctgcttgtgactatttctggggctgggtccggcagcccccagggaagggcctggagtggattgggggtttgtcacattgtgcaggttactacaatactggctggacctaccacaacccgtctctcaagagtcggctcacgatttcactcgacacccccaagaatcaggtcttcctgaagttaaattctgtgaccgccgcggacacggccatttactactgtgcgcgattcgacggcgaagttttggtgtaccacgattggccaaagccggcctgggtcgacctctggggccggggaactttggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 198 - DNA, 405 bp, Artificial Sequence
  Description of Artificial Sequence: Synthetic polynucleotide
cagccgcagctgcaggagtcggggccaggactggtggaggcttcggagaccctgtccctcacctgcactgtgtccggcgactccactgctgcttgtgactatttctggggctgggtccggcagcccccagggaagggcctggagtggattgggggtttgtcacattgtgcaggttactacaatactggctggacctaccacaacccgtctctcaagagtcggctcacgatttcactcgacacccccaagaatcaggtcttcctgaagttaaattctgtgaccgccgcggacacggccatttactactgtgcgcgattcgacggcgaagttttggtgtaccacgattggccaaagccggcctgggtcgacctctggggccggggaactttggtcaccgtctcctca

SEQ ID NO: 199 - protein, 484 aa, Artificial Sequence
  Description of Artificial Sequence: Synthetic polypeptide
MKHLWFFLLLVAAPRWVLSQPQLQESGPGLVEASETLSLTCTVSGDSTAACDYFWGWVRQPPGKGLEWIGGLSHCAGYYNTGWTYHNPSLKSRLTISLDTPKNQVFLKLNSVTAADTAIYYCARFDGEVLVYHDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 135 aa, Artificial Sequence
  Description of Artificial Sequence: Synthetic polypeptide
QPQLQESGPGLVEASETLSLTCTVSGDSTAACDYFWGWVRQPPGKGLEWIGGLSHCAGYYNTGWTYHNPSLKSRLTISLDTPKNQVFLKLNSVTAADTAIYYCARFDGEVLVYHDWPKPAWVDLWGRGTLVTVSS

SEQ ID NO: 201 - protein, 7 aa, Artificial Sequence
  Description of Artificial Sequence: Synthetic peptide
ACDYFWG

SEQ ID NO: 202 - protein, 22 aa, Artificial Sequence
  Description of Artificial Sequence: Synthetic peptide
GLSHCAGYYNTGWTYHNPSLKS

SEQ ID NO: 203 - protein, 19 aa, Artificial Sequence
  Description of Artificial Sequence: Synthetic peptide
FDGEVLVYHDWPKPAWVDL

SEQ ID NO: 204 - protein, 8 aa, Artificial Sequence
  Description of Artificial Sequence: Synthetic peptide
GDSTAACD

SEQ ID NO: 205 - protein, 15 aa, Artificial Sequence
  Description of Artificial Sequence: Synthetic peptide
GLSHCAGYYNTGWTY

SEQ ID NO: 206 - DNA, 693 bp, Artificial Sequence
  Description of Artificial Sequence: Synthetic polynucleotide
atggcctgggctctgctcctcctcaccctcctcactcagggcacaggggcctgggcccagtctgccctgactcagcctccctccgcgtccgggtctcctggacagtcaatctccatctcctgcactggaaccagcaataggtttgtctcctggtaccagcaacacccaggcaaggcccccaaactcgtcatttatggggtcaataagcgcccctcaggtgtccctgatcgtttttctggctccaagtctggcaacacggcctccctgaccgtctctgggctccagactgacgatgaggctgtctattactgcagctcacttgtaggcaactgggatgtgattttcggcggagggaccaagttgaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 207 - DNA, 315 bp, Artificial Sequence
  Description of Artificial Sequence: Synthetic polynucleotide
cagtctgccctgactcagcctccctccgcgtccgggtctcctggacagtcaatctccatctcctgcactggaaccagcaataggtttgtctcctggtaccagcaacacccaggcaaggcccccaaactcgtcatttatggggtcaataagcgcccctcaggtgtccctgatcgtttttctggctccaagtctggcaacacggcctccctgaccgtctctgggctccagactgacgatgaggctgtctattactgcagctcacttgtaggcaactgggatgtgattttcggcggagggaccaagttgaccgtcctg

SEQ ID NO: 208 - protein, 230 aa, Artificial Sequence
  Description of Artificial Sequence: Synthetic polypeptide
MAWALLLLTLLTQGTGAWAQSALTQPPSASGSPGQSISISCTGTSNRFVSWYQQHPGKAPKLVIYGVNKRPSGVPDRFSGSKSGNTASLTVSGLQTDDEAVYYCSSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 209 - protein, 105 aa, Artificial Sequence
  Description of Artificial Sequence: Synthetic polypeptide
QSALTQPPSASGSPGQSISISCTGTSNRFVSWYQQHPGKAPKLVIYGVNKRPSGVPDRFSGSKSGNTASLTVSGLQTDDEAVYYCSSLVGNWDVIFGGGTKLTVL

SEQ ID NO: 210 - protein, 9 aa, Artificial Sequence
  Description of Artificial Sequence: Synthetic peptide
TGTSNRFVS

SEQ ID NO: 211 - protein, 7 aa, Artificial Sequence
  Description of Artificial Sequence: Synthetic peptide
GVNKRPS

SEQ ID NO: 212 - protein, 10 aa, Artificial Sequence
  Description of Artificial Sequence: Synthetic peptide
SSLVGNWDVI

SEQ ID NO: 213 - DNA, 1437 bp, Artificial Sequence
  Description of Artificial Sequence: Synthetic polynucleotide
atgaaacacctgtggttcttcctcctgctggtggcggctcccagatgggtcctgtcccaggtgcagctgcaggagtcgggcccaggactggtgaagcctgcggagaccctgtccctcacctgcagtgtctctggagaatctatcaatactggtcattactactggggctgggtccgtcaggtcccagggaagggacttgagtggataggtcatatccattatacgacggctgtcctgcacaacccgtccctcaagagtcgactcaccatcaaaatttacacgttgagaaaccagattaccctgaggctcagtaatgtgacggccgcggacacggccgtctatcactgcgtacgatccggcggcgacatcttatattattatgagtggcaaaagccgcactggttctctccctggggcccgggaatccacgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 214 - DNA, 387 bp, Artificial Sequence
  Description of Artificial Sequence: Synthetic polynucleotide
caggtgcagctgcaggagtcgggcccaggactggtgaagcctgcggagaccctgtccctcacctgcagtgtctctggagaatctatcaatactggtcattactactggggctgggtccgtcaggtcccagggaagggacttgagtggataggtcatatccattatacgacggctgtcctgcacaacccgtccctcaagagtcgactcaccatcaaaatttacacgttgagaaaccagattaccctgaggctcagtaatgtgacggccgcggacacggccgtctatcactgcgtacgatccggcggcgacatcttatattattatgagtggcaaaagccgcactggttctctccctggggcccgggaatccacgtcaccgtctcgagc

SEQ ID NO: 215 - protein, 478 aa, Artificial Sequence
  Description of Artificial Sequence: Synthetic polypeptide
MKHLWFFLLLVAAPRWVLSQVQLQESGPGLVKPAETLSLTCSVSGESINTGHYYWGWVRQVPGKGLEWIGHIHYTTAVLHNPSLKSRLTIKIYTLRNQITLRLSNVTAADTAVYHCVRSGGDILYYYEWQKPHWFSPWGPGIHVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 129 aa, Artificial Sequence
  Description of Artificial Sequence: Synthetic polypeptide
QVQLQESGPGLVKPAETLSLTCSVSGESINTGHYYWGWVRQVPGKGLEWIGHIHYTTAVLHNPSLKSRLTIKIYTLRNQITLRLSNVTAADTAVYHCVRSGGDILYYYEWQKPHWFSPWGPGIHVTVSS

SEQ ID NO: 217 - protein, 7 aa, Artificial Sequence
  Description of Artificial Sequence: Synthetic peptide
TGHYYWG

SEQ ID NO: 218 - protein, 16 aa, Artificial Sequence
  Description of Artificial Sequence: Synthetic peptide
HIHYTTAVLHNPSLKS

SEQ ID NO: 219 - protein, 19 aa, Artificial Sequence
  Description of Artificial Sequence: Synthetic peptide
SGGDILYYYEWQKPHWFSP

SEQ ID NO: 220 - protein, 8 aa, Artificial Sequence
  Description of Artificial Sequence: Synthetic peptide
GESINTGH

SEQ ID NO: 221 - protein, 9 aa, Artificial Sequence
  Description of Artificial Sequence: Synthetic peptide
HIHYTTAVL

SEQ ID NO: 222 - DNA, 708 bp, Artificial Sequence
  Description of Artificial Sequence: Synthetic polynucleotide
atggcctgggctctgctcctcctcaccctcctcactcagggcacagggtcctgggcccagtctgccctgactcagcctccctccgcgtccgggtctcttggacagtcagtcaccatctcctgcaatggaaccagcagtgacattggcggttggaattttgtctcctggtatcaacagttcccgggcagagcccccagactcattatttttgaggtcaataagcggccctcaggggtccctggtcgcttctctggctccaagtcgggcaattcggcctccctgaccgtctctgggctccagtctgacgatgagggtcaatatttctgcagttcacttttcggcaggtgggatgttgtttttggcggggggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 223 - DNA, 330 bp, Artificial Sequence
  Description of Artificial Sequence: Synthetic polynucleotide
cagtctgccctgactcagcctccctccgcgtccgggtctcttggacagtcagtcaccatctcctgcaatggaaccagcagtgacattggcggttggaattttgtctcctggtatcaacagttcccgggcagagcccccagactcattatttttgaggtcaataagcggccctcaggggtccctggtcgcttctctggctccaagtcgggcaattcggcctccctgaccgtctctgggctccagtctgacgatgagggtcaatatttctgcagttcacttttcggcaggtgggatgttgtttttggcggggggaccaagctgaccgtccta

SEQ ID NO: 224 - protein, 235 aa, Artificial Sequence
  Description of Artificial Sequence: Synthetic polypeptide
MAWALLLLTLLTQGTGSWAQSALTQPPSASGSLGQSVTISCNGTSSDIGGWNFVSWYQQFPGRAPRLIIFEVNKRPSGVPGRFSGSKSGNSASLTVSGLQSDDEGQYFCSSLFGRWDVVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 225 - protein, 110 aa, Artificial Sequence
  Description of Artificial Sequence: Synthetic polypeptide
QSALTQPPSASGSLGQSVTISCNGTSSDIGGWNFVSWYQQFPGRAPRLIIFEVNKRPSGVPGRFSGSKSGNSASLTVSGLQSDDEGQYFCSSLFGRWDVVFGGGTKLTVL

SEQ ID NO: 226 - protein, 14 aa, Artificial Sequence
  Description of Artificial Sequence: Synthetic peptide
NGTSSDIGGWNFVS

SEQ ID NO: 227 - protein, 7 aa, Artificial Sequence
  Description of Artificial Sequence: Synthetic peptide
EVNKRPS

SEQ ID NO: 228 - protein, 10 aa, Artificial Sequence
  Description of Artificial Sequence: Synthetic peptide
SSLFGRWDVV

SEQ ID NO: 229 - DNA, 1449 bp, Artificial Sequence
  Description of Artificial Sequence: Synthetic polynucleotide
atgaaacacctgtggttcttcctcttgctggtggcggctcccagatgggtcctgtcccagttgcagatgcaggagtcgggcccaggactggtgaagccttcggagaccctgtctctgagttgcactgtctctggtgactccataaggggtggcgagtggggcgataaagattatcattggggctgggtccgccactcagcaggaaagggcctggagtggattgggagtatccattggagggggaccacccactacaaagagtccctcaggagaagagtgagtatgtcgatcgacacgtccaggaattggttctccctgaggctggcctctgtgaccgccgcggacacggccgtctacttttgtgcgagacaccgacatcatgatgttttcatgttggtccctattgcgggctggttcgacgtctggggcccgggagtccaggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 230 - DNA, 399 bp, Artificial Sequence
  Description of Artificial Sequence: Synthetic polynucleotide
cagttgcagatgcaggagtcgggcccaggactggtgaagccttcggagaccctgtctctgagttgcactgtctctggtgactccataaggggtggcgagtggggcgataaagattatcattggggctgggtccgccactcagcaggaaagggcctggagtggattgggagtatccattggagggggaccacccactacaaagagtccctcaggagaagagtgagtatgtcgatcgacacgtccaggaattggttctccctgaggctggcctctgtgaccgccgcggacacggccgtctacttttgtgcgagacaccgacatcatgatgttttcatgttggtccctattgcgggctggttcgacgtctggggcccgggagtccaggtcaccgtctcgagc

SEQ ID NO: 231 - protein, 482 aa, Artificial Sequence
  Description of Artificial Sequence: Synthetic polypeptide
MKHLWFFLLLVAAPRWVLSQLQMQESGPGLVKPSETLSLSCTVSGDSIRGGEWGDKDYHWGWVRHSAGKGLEWIGSIHWRGTTHYKESLRRRVSMSIDTSRNWFSLRLASVTAADTAVYFCARHRHHDVFMLVPIAGWFDVWGPGVQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 133 aa, Artificial Sequence [sequence omitted]

SEQ ID NO: 233 - protein, 12 aa, Artificial Sequence
  Description of Artificial Sequence: Synthetic peptide
GGEWGDKDYHWG

SEQ ID NO: 234 - protein, 16 aa, Artificial Sequence
  Description of Artificial Sequence: Synthetic peptide
SIHWRGTTHYKESLRR

SEQ ID NO: 235 - protein, 18 aa, Artificial Sequence
  Description of Artificial Sequence: Synthetic peptide
HRHHDVFMLVPIAGWFDV

SEQ ID NO: 236 - protein, 13 aa, Artificial Sequence
  Description of Artificial Sequence: Synthetic peptide
GDSIRGGEWGDKD

SEQ ID NO: 237 - protein, 9 aa, Artificial Sequence
  Description of Artificial Sequence: Synthetic peptide
SIHWRGTTH

SEQ ID NO: 238 - DNA, 705 bp, Artificial Sequence
  Description of Artificial Sequence: Synthetic polynucleotide
atggaaaccccagctcagcttctcttcctcctgctactctggctcccagataccactggagaaattgtgatgacgcagtctcccgacaccctgtctgtctctccaggggagacagtcacactctcctgcagggccagtcagaatattaacaagaatttagcctggtaccaatacaaacctggccagtctcccaggctcgtaatttttgaaacatatagcaagatcgctgctttccctgccaggttcgttgccagtggttctgggacagagttcactctcaccatcaacaacatgcagtctgaagatgttgcagtttattactgtcaacaatatgaagagtggcctcggacgttcgggcaagggaccaaggtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 239 - DNA, 321 bp, Artificial Sequence
  Description of Artificial Sequence: Synthetic polynucleotide
gaaattgtgatgacgcagtctcccgacaccctgtctgtctctccaggggagacagtcacactctcctgcagggccagtcagaatattaacaagaatttagcctggtaccaatacaaacctggccagtctcccaggctcgtaatttttgaaacatatagcaagatcgctgctttccctgccaggttcgttgccagtggttctgggacagagttcactctcaccatcaacaacatgcagtctgaagatgttgcagtttattactgtcaacaatatgaagagtggcctcggacgttcgggcaagggaccaaggtggatatcaaa

SEQ ID NO: 240 - protein, 234 aa, Artificial Sequence
  Description of Artificial Sequence: Synthetic polypeptide
METPAQLLFLLLLWLPDTTGEIVMTQSPDTLSVSPGETVTLSCRASQNINKNLAWYQYKPGQSPRLVIFETYSKIAAFPARFVASGSGTEFTLTINNMQSEDVAVYYCQQYEEWPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - skipped

SEQ ID NO: 242 - protein, 107 aa, Artificial Sequence
  Description of Artificial Sequence: Synthetic polypeptide
EIVMTQSPDTLSVSPGETVTLSCRASQNINKNLAWYQYKPGQSPRLVIFETYSKIAAFPARFVASGSGTEFTLTINNMQSEDVAVYYCQQYEEWPRTFGQGTKVDIK

SEQ ID NO: 243 - protein, 11 aa, Artificial Sequence
  Description of Artificial Sequence: Synthetic peptide
RASQNINKNLA

SEQ ID NO: 244 - protein, 7 aa, Artificial Sequence
  Description of Artificial Sequence: Synthetic peptide
ETYSKIA

SEQ ID NO: 245 - protein, 9 aa, Artificial Sequence
  Description of Artificial Sequence: Synthetic peptide
QQYEEWPRT

SEQ ID NO: 246 - DNA, 1452 bp, Artificial Sequence
  Description of Artificial Sequence: Synthetic polynucleotide
atgaaacacctgtggttcttcctcctgctagtggcggctcccagatgggtcctgtcgcagctgcagttgcaggaatcgggcccaggactggtgaagccttcggagaccctgtccctgacttgcacagtttctggtggctccatgaggggcaccgactggggcgagaatgacttccactacggctggatccgccagtcctccgcaaaggggctggagtggattgggagcatccattggagggggaggaccacccactacaagacgtccttcaggagtcgggccaccttgtcgatagacacgtccaataatcgcttctccctgacgtttagttttgtgaccgccgcggacacggccgtctactattgtgcgagacataaatatcatgatattttcagggtggtccctgttgcgggctggttcgacccctggggccagggattactggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 247 - DNA, 402 bp, Artificial Sequence
  Description of Artificial Sequence: Synthetic polynucleotide
cagctgcagttgcaggaatcgggcccaggactggtgaagccttcggagaccctgtccctgacttgcacagtttctggtggctccatgaggggcaccgactggggcgagaatgacttccactacggctggatccgccagtcctccgcaaaggggctggagtggattgggagcatccattggagggggaggaccacccactacaagacgtccttcaggagtcgggccaccttgtcgatagacacgtccaataatcgcttctccctgacgtttagttttgtgaccgccgcggacacggccgtctactattgtgcgagacataaatatcatgatattttcagggtggtccctgttgcgggctggttcgacccctggggccagggattactggtcaccgtctcgagc

SEQ ID NO: 248 - protein, 483 aa, Artificial Sequence
  Description of Artificial Sequence: Synthetic polypeptide
MKHLWFFLLLVAAPRWVLSQLQLQESGPGLVKPSETLSLTCTVSGGSMRGTDWGENDFHYGWIRQSSAKGLEWIGSIHWRGRTTHYKTSFRSRATLSIDTSNNRFSLTFSFVTAADTAVYYCARHKYHDIFRVVPVAGWFDPWGQGLLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 249 - protein, 134 aa, Artificial Sequence
  Description of Artificial Sequence: Synthetic polypeptide
QLQLQESGPGLVKPSETLSLTCTVSGGSMRGTDWGENDFHYGWIRQSSAKGLEWIGSIHWRGRTTHYKTSFRSRATLSIDTSNNRFSLTFSFVTAADTAVYYCARHKYHDIFRVVPVAGWFDPWGQGLLVTVSS

SEQ ID NO: 250 - protein, 12 aa, Artificial Sequence
  Description of Artificial Sequence: Synthetic peptide
GTDWGENDFHYG

SEQ ID NO: 251 - protein, 17 aa, Artificial Sequence
  Description of Artificial Sequence: Synthetic peptide
SIHWRGRTTHYKTSFRS

SEQ ID NO: 252 - protein, 18 aa, Artificial Sequence
  Description of Artificial Sequence: Synthetic peptide
HKYHDIFRVVPVAGWFDP

SEQ ID NO: 253 - protein, 13 aa, Artificial Sequence
  Description of Artificial Sequence: Synthetic peptide
GGSMRGTDWGEND

SEQ ID NO: 254 - protein, 10 aa, Artificial Sequence
  Description of Artificial Sequence: Synthetic peptide
SIHWRGRTTH

SEQ ID NO: 255 - DNA, 705 bp, Artificial Sequence
  Description of Artificial Sequence: Synthetic polynucleotide
atggaaaccccagctcagcttctcttcctcctgctactctggctcccagatagcactggagaaatagtgatgacgcagtctccacccaccctgtctgtgtctccaggggaaacagccacactctcctgtagggccagtcagaatgttaagaataatttagcctggtaccagctgaaacctggccaggctcccaggctcctcatctttgatgcgtccagcagggccggtggtattcctgacaggttcagtggcagcggttatgggacagacttcactctcaccgtcaacagtgtgcagtccgaagattttggagattatttttgtcagcaatatgaagagtggcctcggacgttcggccaagggaccaaggtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 256 - DNA, 321 bp, Artificial Sequence
  Description of Artificial Sequence: Synthetic polynucleotide
gaaatagtgatgacgcagtctccacccaccctgtctgtgtctccaggggaaacagccacactctcctgtagggccagtcagaatgttaagaataatttagcctggtaccagctgaaacctggccaggctcccaggctcctcatctttgatgcgtccagcagggccggtggtattcctgacaggttcagtggcagcggttatgggacagacttcactctcaccgtcaacagtgtgcagtccgaagattttggagattatttttgtcagcaatatgaagagtggcctcggacgttcggccaagggaccaaggtggatatcaaa

SEQ ID NO: 257 - protein, 234 aa, Artificial Sequence
  Description of Artificial Sequence: Synthetic polypeptide
METPAQLLFLLLLWLPDSTGEIVMTQSPPTLSVSPGETATLSCRASQNVKNNLAWYQLKPGQAPRLLIFDASSRAGGIPDRFSGSGYGTDFTLTVNSVQSEDFGDYFCQQYEEWPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - protein, 107 aa, Artificial Sequence
  Description of Artificial Sequence: Synthetic polypeptide
EIVMTQSPPTLSVSPGETATLSCRASQNVKNNLAWYQLKPGQAPRLLIFDASSRAGGIPDRFSGSGYGTDFTLTVNSVQSEDFGDYFCQQYEEWPRTFGQGTKVDIK

SEQ ID NO: 259 - protein, 11 aa, Artificial Sequence
  Description of Artificial Sequence: Synthetic peptide
RASQNVKNNLA

SEQ ID NO: 260 - protein, 7 aa, Artificial Sequence
  Description of Artificial Sequence: Synthetic peptide
DASSRAG

SEQ ID NO: 261 - protein, 5 aa, Artificial Sequence
  Description of Artificial Sequence: Synthetic peptide
DNYWS

SEQ ID NO: 262 - protein, 24 aa, Artificial Sequence
  Description of Artificial Sequence: Synthetic peptide
TKHGRRIYGVVAFKEWFTYFYMDV

SEQ ID NO: 263 - protein, 6 aa, Artificial Sequence
  Description of Artificial Sequence: Synthetic peptide
GTLVRD

SEQ ID NO: 264 - protein, 9 aa, Artificial Sequence
  Description of Artificial Sequence: Synthetic peptide
YVHDSGDTN

SEQ ID NO: 265 - protein, 16 aa, Artificial Sequence
  Description of Artificial Sequence: Synthetic peptide
YVHKSGDTNYSPSLKS

SEQ ID NO: 266 - protein, 6 aa, Artificial Sequence
  Description of Artificial Sequence: Synthetic peptide
GFTFHK

SEQ ID NO: 267 - protein, 10 aa, Artificial Sequence
  Description of Artificial Sequence: Synthetic peptide
LISDDGMRKY

SEQ ID NO: 268 - protein, 6 aa, Artificial Sequence
  Description of Artificial Sequence: Synthetic peptide
GGTFSS

SEQ ID NO: 269 - protein, 10 aa, Artificial Sequence
  Description of Artificial Sequence: Synthetic peptide
MVTPIFGEAK

SEQ ID NO: 270 - protein, 6 aa, Artificial Sequence
  Description of Artificial Sequence: Synthetic peptide
GGAFSS

SEQ ID NO: 271 - protein, 10 aa, Artificial Sequence
  Description of Artificial Sequence: Synthetic peptide
MITPVFGETK

SEQ ID NO: 272 - protein, 10 aa, Artificial Sequence
  Description of Artificial Sequence: Synthetic peptide
FIKYDGSEKY

SEQ ID NO: 273 - DNA, 1473 bp, Artificial Sequence
  Description of Artificial Sequence: Synthetic polynucleotide
atggactggatttggaggatcctcttcttggtggcagcagttgcaagtgcccactcgcaggtgcagctggtgcagtctgggccggaggtgaagaagcctgggtcctcagtgaaggtctcctgcaaggcctctggaaacaccttcagtaaatatgatgtccactgggtacgacaggccactggacaggggcttgaatgggtgggatggatgagtcatgagggtgataagacagaatctgcacagagatttaagggccgagtcaccttcacgagggacacttccgcaagcacagcctacatggaactgcgcggcctgacatctgacgacacggccatctattattgtacgagaggctcaaaacatcgtttgcgagactacgttctctacgatgactacggcttaattaattatcaagagtggaatgactaccttgaatttttggacgtctggggccatggaaccgcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 274 - DNA, 423 bp, Artificial Sequence
  Description of Artificial Sequence: Synthetic polynucleotide
caggtgcagctggtgcagtctgggccggaggtgaagaagcctgggtcctcagtgaaggtctcctgcaaggcctctggaaacaccttcagtaaatatgatgtccactgggtacgacaggccactggacaggggcttgaatgggtgggatggatgagtcatgagggtgataagacagaatctgcacagagatttaagggccgagtcaccttcacgagggacacttccgcaagcacagcctacatggaactgcgcggcctgacatctgacgacacggccatctattattgtacgagaggctcaaaacatcgtttgcgagactacgttctctacgatgactacggcttaattaattatcaagagtggaatgactaccttgaatttttggacgtctggggccatggaaccgcggtcaccgtctcctca

SEQ ID NO: 275 - protein, 490 aa, Artificial Sequence
  Description of Artificial Sequence: Synthetic polypeptide
MDWIWRILFLVAAVASAHSQVQLVQSGPEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - protein, 141 aa, Artificial Sequence
  Description of Artificial Sequence: Synthetic polypeptide
QVQLVQSGPEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 277 - protein, 5 aa, Artificial Sequence
  Description of Artificial Sequence: Synthetic peptide
KYDVH

SEQ ID NO: 278 - protein, 17 aa, Artificial Sequence
  Description of Artificial Sequence: Synthetic peptide
WMSHEGDKTESAQRFKG

SEQ ID NO: 279 - protein, 32 aa, Artificial Sequence
  Description of Artificial Sequence: Synthetic polypeptide
GSKHRLRDYVLYDDYGLINYQEWNDYLEFLDV

SEQ ID NO: 280 - protein, 6 aa, Artificial Sequence
  Description of Artificial Sequence: Synthetic peptide
GNTFSK

SEQ ID NO: 281 - protein, 10 aa, Artificial Sequence
  Description of Artificial Sequence: Synthetic peptide
WMSHEGDKTE

SEQ ID NO: 282 - DNA, 720 bp, Artificial Sequence
  Description of Artificial Sequence: Synthetic polynucleotide
atgaggctccctgctcagctcctggggctgctaatgctctgggtctctggatccagtgcggatactgtcgtgactcagtctccactctccctgcccgtcacccctggagaggcggcctccatgtcctgttcgtcgactcagagcctccggcatagtaatggagccaactatttggcttggtatcagcacaaaccggggcagtctccacgactcctaatccgtttaggttctcaacgggcctccggggtccctgacagattcagtggcagtggatcaggcactcattttacactgaaaatcagtagagtggaggctgaagatgctgcaatttattattgcatgcaaggtctgaaccgtccctggacgttcggcaaggggaccaagttggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 283 - DNA, 336 bp, Artificial Sequence
  Description of Artificial Sequence: Synthetic polynucleotide
gatactgtcgtgactcagtctccactctccctgcccgtcacccctggagaggcggcctccatgtcctgttcgtcgactcagagcctccggcatagtaatggagccaactatttggcttggtatcagcacaaaccggggcagtctccacgactcctaatccgtttaggttctcaacgggcctccggggtccctgacagattcagtggcagtggatcaggcactcattttacactgaaaatcagtagagtggaggctgaagatgctgcaatttattattgcatgcaaggtctgaaccgtccctggacgttcggcaaggggaccaagttggaaatcaaa

SEQ ID NO: 284 - protein, 239 aa, Artificial Sequence
  Description of Artificial Sequence: Synthetic polypeptide
MRLPAQLLGLLMLWVSGSSADTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 285 - protein, 112 aa, Artificial Sequence
  Description of Artificial Sequence: Synthetic polypeptide
DTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIK

SEQ ID NO: 286 - protein, 16 aa, Artificial Sequence
  Description of Artificial Sequence: Synthetic peptide
SSTQSLRHSNGANYLA

SEQ ID NO: 287 - protein, 7 aa, Artificial Sequence
  Description of Artificial Sequence: Synthetic peptide
LGSQRAS

SEQ ID NO: 288 - protein, 9 aa, Artificial Sequence
  Description of Artificial Sequence: Synthetic peptide
MQGLNRPWT

SEQ ID NO: 289 - DNA, 1473 bp, Artificial Sequence
  Description of Artificial Sequence: Synthetic polynucleotide
atggactggatttggaggatcctcttcttggtggcagcagttgcaagtgcccactcgcaggtgcagctggtgcagtctgggcctgaggtgaagaagcctgggtcctcagtgaaggtctcctgcaaggcctctggaaacaccttcagtaaatatgatgtccactgggtacggcaggccactggacaggggcttgaatgggtgggatggatgagtcatgagggtgataagacagaatctgcacagagatttaagggccgagtcaccttcacgagggacacttccgcaagcacagcctacatggaactgcgcggcctgacatctgacgacacggccatttattattgtacgagaggctcaaaacatcgcttgcgagactatgttctctacgatgactacggcttaattaattatcaagagtggaatgactaccttgaatttttggacgtctggggccatggaaccgcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 290 - DNA, 423 bp, Artificial Sequence
  Description of Artificial Sequence: Synthetic polynucleotide
caggtgcagctggtgcagtctgggcctgaggtgaagaagcctgggtcctcagtgaaggtctcctgcaaggcctctggaaacaccttcagtaaatatgatgtccactgggtacggcaggccactggacaggggcttgaatgggtgggatggatgagtcatgagggtgataagacagaatctgcacagagatttaagggccgagtcaccttcacgagggacacttccgcaagcacagcctacatggaactgcgcggcctgacatctgacgacacggccatttattattgtacgagaggctcaaaacatcgcttgcgagactatgttctctacgatgactacggcttaattaattatcaagagtggaatgactaccttgaatttttggacgtctggggccatggaaccgcggtcaccgtctcctca

SEQ ID NO: 291 - protein, 490 aa, Artificial Sequence
  Description of Artificial Sequence: Synthetic polypeptide
MDWIWRILFLVAAVASAHSQVQLVQSGPEVKKPGSSVKVSCKASGNTFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 141 aa, Artificial Sequence
  Description of Artificial Sequence: Synthetic polypeptide
QVQLVQSGPEVKKPGSSVKVSCKASGNTFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSS

SEQ ID NO: 293 - protein, 17 aa, Artificial Sequence
  Description of Artificial Sequence: Synthetic peptide
WISHERDKTESAQRFKG

SEQ ID NO: 294 - protein, 10 aa, Artificial Sequence
  Description of Artificial Sequence: Synthetic peptide
WISHERDKTE

SEQ ID NO: 295 - DNA, 1473 bp, Artificial Sequence
  Description of Artificial Sequence: Synthetic polynucleotide
atggactggatttggaggatcctcttcttggtggcagcagttgcaagtgcccacgcgcaggtgcagctggagcagtctggggctgaggtgaagaagcctgggtcctcagtgaaggtctcctgcaaggcctctggaaacaccttcagtaaatatgatgtccactgggtacgacaggccactggacaggggcttgaatgggtgggatggatgagtcatgagggtgataagacagaatctgcacagagatttaaggggcgagtcaccttcacgagggacacttccgcaagcacagcctacatggaactgcgcggcctgacatctgacgacacggccatttattattgtacgagaggttcaaaacatcgcttgcgagactacgttctctacgatgactacggcttaattaattatcaagagtggaatgactaccttgaatttttggacgtctggggccatggaaccgcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 296 - DNA, 423 bp, Artificial Sequence
  Description of Artificial Sequence: Synthetic polynucleotide
caggtgcagctggagcagtctggggctgaggtgaagaagcctgggtcctcagtgaaggtctcctgcaaggcctctggaaacaccttcagtaaatatgatgtccactgggtacgacaggccactggacaggggcttgaatgggtgggatggatgagtcatgagggtgataagacagaatctgcacagagatttaaggggcgagtcaccttcacgagggacacttccgcaagcacagcctacatggaactgcgcggcctgacatctgacgacacggccatttattattgtacgagaggttcaaaacatcgcttgcgagactacgttctctacgatgactacggcttaattaattatcaagagtggaatgactaccttgaatttttggacgtctggggccatggaaccgcggtcaccgtctcctca

SEQ ID NO: 297 - protein, 490 aa, Artificial Sequence
  Description of Artificial Sequence: Synthetic polypeptide
MDWIWRILFLVAAVASAHAQVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 141 aa, Artificial Sequence
  Description of Artificial Sequence: Synthetic polypeptide
QVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 299 - DNA, 720 bp, Artificial Sequence
  Description of Artificial Sequence: Synthetic polynucleotide
atgaggctccctgctcagctcctggggctgctaatgctctgggtctctggatccagtgcggatactgtcgtgactcagtctccactctccctgcccgtcacccctggagaggcggcctccatgtcctgtacgtcgactcagagcctccgtcatagtaatggagccaactatttggcttggtaccagcacaaaccagggcagtctccacgactcctaatccgtttaggttctcaacgggcctccggggtccctgacagattcagtggcagtggatcaggcactcattttacactgaaaatcagtcgagtggagcctgaagatgctgcaatttattattgcatgcaaggtctgaaccgtccctggacgttcggcaaggggaccaagttggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 300 - DNA, 336 bp, Artificial Sequence
  Description of Artificial Sequence: Synthetic polynucleotide
gatactgtcgtgactcagtctccactctccctgcccgtcacccctggagaggcggcctccatgtcctgtacgtcgactcagagcctccgtcatagtaatggagccaactatttggcttggtaccagcacaaaccagggcagtctccacgactcctaatccgtttaggttctcaacgggcctccggggtccctgacagattcagtggcagtggatcaggcactcattttacactgaaaatcagtcgagtggagcctgaagatgctgcaatttattattgcatgcaaggtctgaaccgtccctggacgttcggcaaggggaccaagttggaaatcaaa

SEQ ID NO: 301 - protein, 239 aa, Artificial Sequence
  Description of Artificial Sequence: Synthetic polypeptide
MRLPAQLLGLLMLWVSGSSADTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 112 aa, Artificial Sequence
  Description of Artificial Sequence: Synthetic polypeptide
DTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIK

SEQ ID NO: 303 - protein, 16 aa, Artificial Sequence
  Description of Artificial Sequence: Synthetic peptide
TSTQSLRHSNGANYLA

SEQ ID NO: 304 - DNA, 1473 bp, Artificial Sequence
  Description of Artificial Sequence: Synthetic polynucleotide
atggactggatttggaggatcctcttcttggtggcagcagttgcaagtgcccactcgcaggtgcagctggtgcagtctggggctgaggtgaagaagcctgggtcctcagtgaaggtctcctgcaaggcctctggaaacaccttcaggaaatatgatgtccactgggtacgacaggccactggacaggggcttgaatgggtgggatggatgagtcatgagggtgataagacagaatctgcacagagatttaagggccgagtctctttcacgagggacaattccgcaagcacagcctacattgaactgcgcggcctgacatctgacgacacggccatttattattgtaccggaggctcaaaacatcgcttgcgagactacgttctctacgatgattacggcctaataaatcagcaagagtggaatgactaccttgaatttttggacgtctggggccatggaaccgcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 305 - DNA, 423 bp, Artificial Sequence
  Description of Artificial Sequence: Synthetic polynucleotide
caggtgcagctggtgcagtctggggctgaggtgaagaagcctgggtcctcagtgaaggtctcctgcaaggcctctggaaacaccttcaggaaatatgatgtccactgggtacgacaggccactggacaggggcttgaatgggtgggatggatgagtcatgagggtgataagacagaatctgcacagagatttaagggccgagtctctttcacgagggacaattccgcaagcacagcctacattgaactgcgcggcctgacatctgacgacacggccatttattattgtaccggaggctcaaaacatcgcttgcgagactacgttctctacgatgattacggcctaataaatcagcaagagtggaatgactaccttgaatttttggacgtctggggccatggaaccgcggtcaccgtctcctca

SEQ ID NO: 306 - protein, 490 aa, Artificial Sequence
  Description of Artificial Sequence: Synthetic polypeptide
MDWIWRILFLVAAVASAHSQVQLVQSGAEVKKPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 141 aa, Artificial Sequence
  Description of Artificial Sequence: Synthetic polypeptide
QVQLVQSGAEVKKPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSS

SEQ ID NO: 308 - protein, 32 aa, Artificial Sequence
  Description of Artificial Sequence: Synthetic polypeptide
GSKHRLRDYVLYDDYGLINQQEWNDYLEFLDV

SEQ ID NO: 309 - protein, 6 aa, Artificial Sequence
  Description of Artificial Sequence: Synthetic peptide
GNTFRK

SEQ ID NO: 310 - DNA, 720 bp, Artificial Sequence
  Description of Artificial Sequence: Synthetic polynucleotide
atgaggctccctgctcagctcctggggctgctaatgctctgggtctctggatccagtgcggatactgtcgtgactcagtctccactctccctgtccgtcacccctggagaggcggcctccatgtcctgtacgtcgactcagagcctccggcatagtaatggagccaactatttggcttggtaccagcacaaaccagggcagtctccacgactcctaatccgtttaggttctcaacgggcctccggggtccctgacagattcagtggcagtggatcaggcactcattttacactgaaaatcagtagagtggaggctgacgatgctgcaatttattattgcatgcaaggtctgaaccgtccctggacgttcggcaaggggaccaagttggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 311 - DNA, 336 bp, Artificial Sequence
  Description of Artificial Sequence: Synthetic polynucleotide
gatactgtcgtgactcagtctccactctccctgtccgtcacccctggagaggcggcctccatgtcctgtacgtcgactcagagcctccggcatagtaatggagccaactatttggcttggtaccagcacaaaccagggcagtctccacgactcctaatccgtttaggttctcaacgggcctccggggtccctgacagattcagtggcagtggatcaggcactcattttacactgaaaatcagtagagtggaggctgacgatgctgcaatttattattgcatgcaaggtctgaaccgtccctggacgttcggcaaggggaccaagttggagatcaaa

SEQ ID NO: 312 - protein, 239 aa, Artificial Sequence
  Description of Artificial Sequence: Synthetic polypeptide
MRLPAQLLGLLMLWVSGSSADTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 112 aa, Artificial Sequence
  Description of Artificial Sequence: Synthetic polypeptide
DTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIK

SEQ ID NO: 314 - DNA, 1473 bp, Artificial Sequence
  Description of Artificial Sequence: Synthetic polynucleotide
atggactggatttggaggatcctcttcttggtggcagcagttgcaagtgcccactcgcaggtgcagctggtgcagtctgggcctgaggtgaagaagcctgggtcctcagtgaaggtctcctgcaaggcctctggaaacaccttcagtaaatatgatgtccactgggtacgacaggccactggacaggggcttgaatgggtgggatggattagtcatgagcgtgataagacagaatctgcacagagatttaagggccgagtcaccttcacgagggacacttccgcaaccacagcctacatggaactgcgcggcctgacatctgacgacacggccatttattattgtacgagaggctcaaaacatcgcttgcgagactacgttctctacgatgactacggcttaattaattatcaagagtggaatgactaccttgaatttttggacgtctggggccatggaaccgcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 315 - DNA, 423 bp, Artificial Sequence
  Description of Artificial Sequence: Synthetic polynucleotide
caggtgcagctggtgcagtctgggcctgaggtgaagaagcctgggtcctcagtgaaggtctcctgcaaggcctctggaaacaccttcagtaaatatgatgtccactgggtacgacaggccactggacaggggcttgaatgggtgggatggattagtcatgagcgtgataagacagaatctgcacagagatttaagggccgagtcaccttcacgagggacacttccgcaaccacagcctacatggaactgcgcggcctgacatctgacgacacggccatttattattgtacgagaggctcaaaacatcgcttgcgagactacgttctctacgatgactacggcttaattaattatcaagagtggaatgactaccttgaatttttggacgtctggggccatggaaccgcggtcaccgtctcctca

SEQ ID NO: 316 - DNA, 1458 bp, Artificial Sequence
  Description of Artificial Sequence: Synthetic polynucleotide
atgaaacacctgtggttcttcctcctgctggtggcggctcccagatgggtcctgtcccagccgcagctgcaggagtcgggcccaggactggtggaggcttcggagaccctgtccctcacgtgcactgtgtccggcgactccactggtcgttgtaattatttctggggctgggtccggcagcccccagggaaggggctggagtggattgggagtttgtcccactgtagaagttactacaatactgactggacctaccacaacccgtctctcaagagtcgactcactatttcactcgacacgcccaagaatcaggtcttcctgagattgacctctgtgaccgccgcggacacggccacttattactgtgcgcgattcggcggcgaagttctagtgtacagagattggccaaagccggcctgggtcgacctctggggccggggaacgctggtcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 317 - DNA, 408 bp, Artificial Sequence
  Description of Artificial Sequence: Synthetic polynucleotide
cagccgcagctgcaggagtcgggcccaggactggtggaggcttcggagaccctgtccctcacgtgcactgtgtccggcgactccactggtcgttgtaattatttctggggctgggtccggcagcccccagggaaggggctggagtggattgggagtttgtcccactgtagaagttactacaatactgactggacctaccacaacccgtctctcaagagtcgactcactatttcactcgacacgcccaagaatcaggtcttcctgagattgacctctgtgaccgccgcggacacggccacttattactgtgcgcgattcggcggcgaagttctagtgtacagagattggccaaagccggcctgggtcgacctctggggccggggaacgctggtcgtcaccgtctcgagc

SEQ ID NO: 318 - protein, 485 aa, Artificial Sequence
  Description of Artificial Sequence: Synthetic polypeptide
MKHLWFFLLLVAAPRWVLSQPQLQESGPGLVEASETLSLTCTVSGDSTGRCNYFWGWVRQPPGKGLEWIGSLSHCRSYYNTDWTYHNPSLKSRLTISLDTPKNQVFLRLTSVTAADTATYYCARFGGEVLVYRDWPKPAWVDLWGRGTLVVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 319 - protein, 136 aa, Artificial Sequence
  Description of Artificial Sequence: Synthetic polypeptide
QPQLQESGPGLVEASETLSLTCTVSGDSTGRCNYFWGWVRQPPGKGLEWIGSLSHCRSYYNTDWTYHNPSLKSRLTISLDTPKNQVFLRLTSVTAADTATYYCARFGGEVLVYRDWPKPAWVDLWGRGTLVVTVSS

SEQ ID NO: 320 - protein, 7 aa, Artificial Sequence
  Description of Artificial Sequence: Synthetic peptide
RCNYFWG

SEQ ID NO: 321 - protein, 22 aa, Artificial Sequence
  Description of Artificial Sequence: Synthetic peptide
SLSHCRSYYNTDWTYHNPSLKS

SEQ ID NO: 322 - protein, 19 aa, Artificial Sequence
  Description of Artificial Sequence: Synthetic peptide
FGGEVLVYRDWPKPAWVDL

SEQ ID NO: 323 - protein, 8 aa, Artificial Sequence
  Description of Artificial Sequence: Synthetic peptide
GDSTGRCN

SEQ ID NO: 324 - protein, 15 aa, Artificial Sequence
  Description of Artificial Sequence: Synthetic peptide
SLSHCRSYYNTDWTY

SEQ ID NO: 325 - protein, 9 aa, Artificial Sequence
  Description of Artificial Sequence: Synthetic peptide
TGTSNNFVS

SEQ ID NO: 326 - protein, 7 aa, Artificial Sequence
  Description of Artificial Sequence: Synthetic peptide
ACNSFWG

SEQ ID NO: 327 - DNA, 693 bp, Artificial Sequence
  Description of Artificial Sequence: Synthetic polynucleotide
atggcctgggctctgctcctcctcaccctcctcactcagggcacaggggcctgggcccagtctgccctgactcagcctccctccgcgtccgggtctcctggacagtcaatcaccatctcctgcactggaaccagcaataactttgtctcctggtaccaacaatacccaggcaaggcccccaaactcgtcatttatgaggtcaataagcgcccctcaggtgtccctgatcgtttctctggctccaagtctggcagcacggcctccctgaccgtctctggactccaggctgacgatgagggtgtctattattgtagttcacttgtaggcaactgggatgtgattttcggcggagggaccaagttgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 328 - DNA, 315 bp, Artificial Sequence
  Description of Artificial Sequence: Synthetic polynucleotide
cagtctgccctgactcagcctccctccgcgtccgggtctcctggacagtcaatcaccatctcctgcactggaaccagcaataactttgtctcctggtaccaacaatacccaggcaaggcccccaaactcgtcatttatgaggtcaataagcgcccctcaggtgtccctgatcgtttctctggctccaagtctggcagcacggcctccctgaccgtctctggactccaggctgacgatgagggtgtctattattgtagttcacttgtaggcaactgggatgtgattttcggcggagggaccaagttgaccgtccta

SEQ ID NO: 329 - protein, 230 aa, Artificial Sequence
  Description of Artificial Sequence: Synthetic polypeptide
MAWALLLLTLLTQGTGAWAQSALTQPPSASGSPGQSITISCTGTSNNFVSWYQQYPGKAPKLVIYEVNKRPSGVPDRFSGSKSGSTASLTVSGLQADDEGVYYCSSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 330 - protein, 105 aa, Artificial Sequence
  Description of Artificial Sequence: Synthetic polypeptide
QSALTQPPSASGSPGQSITISCTGTSNNFVSWYQQYPGKAPKLVIYEVNKRPSGVPDRFSGSKSGSTASLTVSGLQADDEGVYYCSSLVGNWDVIFGGGTKLTVL

SEQ ID NO: 331 - DNA, 1455 bp, Artificial Sequence
  Description of Artificial Sequence: Synthetic polynucleotide
atgaaacacctgtggttcttcctcctgctggtggcggctcccagatgggtcctgtcccagccgcagctgcaggagtcgggcccaacactggtggaggcttcggagactctgtccctcacctgcgctgtgtccggcgactccactgctgcatgtaattctttctggggctgggtccggcagcccccagggaaggggctggagtgggttgggagtttgtcccattgtgcaagctattggaatcgtgggtggacctaccacaacccgtctctcaagagtcggctcacgcttgctctcgacacacccaagaatctggtcttcctcaaattaaattctgtgactgccgcggacacggccacttactactgtgcgcgattcggcggcgaagttttacgctacacggattggccaaagccggcctgggtcgacctctggggccggggaacgctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 332 - DNA, 405 bp, Artificial Sequence
  Description of Artificial Sequence: Synthetic polynucleotide
cagccgcagctgcaggagtcgggcccaacactggtggaggcttcggagactctgtccctcacctgcgctgtgtccggcgactccactgctgcatgtaattctttctggggctgggtccggcagcccccagggaaggggctggagtgggttgggagtttgtcccattgtgcaagctattggaatcgtgggtggacctaccacaacccgtctctcaagagtcggctcacgcttgctctcgacacacccaagaatctggtcttcctcaaattaaattctgtgactgccgcggacacggccacttactactgtgcgcgattcggcggcgaagttttacgctacacggattggccaaagccggcctgggtcgacctctggggccggggaacgctggtcaccgtctcgagc

SEQ ID NO: 333 - protein, 484 aa, Artificial Sequence
  Description of Artificial Sequence: Synthetic polypeptide
MKHLWFFLLLVAAPRWVLSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 334 - protein, 135 aa, Artificial Sequence
  Description of Artificial Sequence: Synthetic polypeptide
QPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSS

SEQ ID NO: 335 - protein, 22 aa, Artificial Sequence
  Description of Artificial Sequence: Synthetic peptide
SLSHCASYWNRGWTYHNPSLKS

SEQ ID NO: 336 - protein, 19 aa, Artificial Sequence
  Description of Artificial Sequence: Synthetic peptide
FGGEVLRYTDWPKPAWVDL

SEQ ID NO: 337 - protein, 8 aa, Artificial Sequence
  Description of Artificial Sequence: Synthetic peptide
GDSTAACN

SEQ ID NO: 338 - protein, 15 aa, Artificial Sequence
  Description of Artificial Sequence: Synthetic peptide
SLSHCASYWNRGWTY

SEQ ID NO: 339-342 - skipped (4 entries)

SEQ ID NO: 343 - protein, 7 aa, Artificial Sequence
  Description of Artificial Sequence: Synthetic peptide
DVNKRPS

SEQ ID NO: 344 - DNA, 1437 bp, Artificial Sequence
  Description of Artificial Sequence: Synthetic polynucleotide
atgaaacacctgtggttcttcctcctgctggtggcggctcccagatgggtcctttcccaggtgcaactacaggagtcgggcccaggactggtgaagccttcggagaccctttccctcacctgcactgtctctggtgactccatcaacactggtcatcactactggggctgggtccgtcaggtcccagggaagggaccggaatggattgctcacatccactataatacggctgtcttacacaatccggccctcaagagtcgagtcaccatttcgattttcaccctgaagaatctgattaccctgagcctcagtaatgtgaccgccgcggacacggccgtctatttctgcgttcgatccggcggcgacattttatactatattgagtggcaaaaaccccactggttctatccctggggcccgggaattttggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 345 - DNA, 387 bp, Artificial Sequence
  Description of Artificial Sequence: Synthetic polynucleotide
caggtgcaactacaggagtcgggcccaggactggtgaagccttcggagaccctttccctcacctgcactgtctctggtgactccatcaacactggtcatcactactggggctgggtccgtcaggtcccagggaagggaccggaatggattgctcacatccactataatacggctgtcttacacaatccggccctcaagagtcgagtcaccatttcgattttcaccctgaagaatctgattaccctgagcctcagtaatgtgaccgccgcggacacggccgtctatttctgcgttcgatccggcggcgacattttatactatattgagtggcaaaaaccccactggttctatccctggggcccgggaattttggtcaccgtctcgagc

SEQ ID NO: 346 - protein, 478 aa, Artificial Sequence
  Description of Artificial Sequence: Synthetic polypeptide
MKHLWFFLLLVAAPRWVLSQVQLQESGPGLVKPSETLSLTCTVSGDSINTGHHYWGWVRQVPGKGPEWIAHIHYNTAVLHNPALKSRVTISIFTLKNLITLSLSNVTAADTAVYFCVRSGGDILYYIEWQKPHWFYPWGPGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - protein, 129 aa, Artificial Sequence
  Description of Artificial Sequence: Synthetic polypeptide
QVQLQESGPGLVKPSETLSLTCTVSGDSINTGHHYWGWVRQVPGKGPEWIAHIHYNTAVLHNPALKSRVTISIFTLKNLITLSLSNVTAADTAVYFCVRSGGDILYYIEWQKPHWFYPWGPGILVTVSS

SEQ ID NO: 348 - protein, 7 aa, Artificial Sequence
  Description of Artificial Sequence: Synthetic peptide
TGHHYWG

SEQ ID NO: 349 - protein, 16 aa, Artificial Sequence
  Description of Artificial Sequence: Synthetic peptide
HIHYNTAVLHNPALKS

SEQ ID NO: 350 - protein, 19 aa, Artificial Sequence
  Description of Artificial Sequence: Synthetic peptide
SGGDILYYIEWQKPHWFYP

SEQ ID NO: 351 - protein, 8 aa, Artificial Sequence
  Description of Artificial Sequence: Synthetic peptide
GDSINTGH

SEQ ID NO: 352 - protein, 9 aa, Artificial Sequence
  Description of Artificial Sequence: Synthetic peptide
HIHYNTAVL

SEQ ID NO: 353 - DNA, 708 bp, Artificial Sequence
  Description of Artificial Sequence: Synthetic polynucleotide
atggcctgggctctgctcctcctcaccctcctcactcagggcacagggtcctgggcccagtctgccctgactcagcctccctccgcgtccgggtctcttggacagtcactcaccatctcctgcagtggaaccggcagtgacattggcagttggaattttgtctcctggtatcaacaattcccaggcagagcccccaacctcattatttttgaggtcaataggcggcgatcaggggtccctgatcgcttctctggttccaagtcgggcaatacggcctccctgaccgtctctgggctccggtctgaggatgaggctgaatatttttgcagttccctttcaggcaggtgggacattgtttttggcggagggaccaaggtgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 354 - DNA, 330 bp, Artificial Sequence
  Description of Artificial Sequence: Synthetic polynucleotide
cagtctgccctgactcagcctccctccgcgtccgggtctcttggacagtcactcaccatctcctgcagtggaaccggcagtgacattggcagttggaattttgtctcctggtatcaacaattcccaggcagagcccccaacctcattatttttgaggtcaataggcggcgatcaggggtccctgatcgcttctctggttccaagtcgggcaatacggcctccctgaccgtctctgggctccggtctgaggatgaggctgaatatttttgcagttccctttcaggcaggtgggacattgtttttggcggagggaccaaggtgaccgtccta

SEQ ID NO: 355 - protein, 235 aa, Artificial Sequence
  Description of Artificial Sequence: Synthetic polypeptide
MAWALLLLTLLTQGTGSWAQSALTQPPSASGSLGQSLTISCSGTGSDIGSWNFVSWYQQFPGRAPNLIIFEVNRRRSGVPDRFSGSKSGNTASLTVSGLRSEDEAEYFCSSLSGRWDIVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 356 - protein, 110 aa, Artificial Sequence
  Description of Artificial Sequence: Synthetic polypeptide
QSALTQPPSASGSLGQSLTISCSGTGSDIGSWNFVSWYQQFPGRAPNLIIFEVNRRRSGVPDRFSGSKSGNTASLTVSGLRSEDEAEYFCSSLSGRWDIVFGGGTKVTVL

SEQ ID NO: 357 - protein, 14 aa, Artificial Sequence
  Description of Artificial Sequence: Synthetic peptide
SGTGSDIGSWNFVS

SEQ ID NO: 358 - protein, 7 aa, Artificial Sequence
  Description of Artificial Sequence: Synthetic peptide
EVNRRRS

SEQ ID NO: 359 - protein, 10 aa, Artificial Sequence
  Description of Artificial Sequence: Synthetic peptide
SSLSGRWDIV

SEQ ID NO: 360 - DNA, 1449 bp, Artificial Sequence
  Description of Artificial Sequence: Synthetic polynucleotide
atgaaacacctgtggttcttcctcctgctggttgcggctcccagatgtgtcctgtctgaggtgcatctggaggagtcgggcccaggactggtgaggccctcggagaccttgtccctgacttgcacggcctctggtggctccataagggggggcgagtggggcgatagtgactaccactggggctgggtccgccactctcccgaaaagggactggaatggattggaagtattcattggcgggggaccacccactacaacgcgcccttccgggggcgaggcagattgtcgatagacctctcccggaatcaattctccctgcgcctgacgtctgtgaccgccgaagacactgccgtctattattgtgtgaagcacaaatatcatgacattgtcatggtggtccccattgcgggctggttcgacccctggggccagggactccaggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 361 - DNA, 399 bp, Artificial Sequence
  Description of Artificial Sequence: Synthetic polynucleotide
gaggtgcatctggaggagtcgggcccaggactggtgaggccctcggagaccttgtccctgacttgcacggcctctggtggctccataagggggggcgagtggggcgatagtgactaccactggggctgggtccgccactctcccgaaaagggactggaatggattggaagtattcattggcgggggaccacccactacaacgcgcccttccgggggcgaggcagattgtcgatagacctctcccggaatcaattctccctgcgcctgacgtctgtgaccgccgaagacactgccgtctattattgtgtgaagcacaaatatcatgacattgtcatggtggtccccattgcgggctggttcgacccctggggccagggactccaggtcaccgtctcgagc

SEQ ID NO: 362 - protein, 482 aa, Artificial Sequence
  Description of Artificial Sequence: Synthetic polypeptide
MKHLWFFLLLVAAPRCVLSEVHLEESGPGLVRPSETLSLTCTASGGSIRGGEWGDSDYHWGWVRHSPEKGLEWIGSIHWRGTTHYNAPFRGRGRLSIDLSRNQFSLRLTSVTAEDTAVYYCVKHKYHDIVMVVPIAGWFDPWGQGLQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 133 aa, Artificial Sequence
  Description of Artificial Sequence: Synthetic polypeptide
EVHLEESGPGLVRPSETLSLTCTASGGSIRGGEWGDSDYHWGWVRHSPEKGLEWIGSIHWRGTTHYNAPFRGRGRLSIDLSRNQFSLRLTSVTAEDTAVYYCVKHKYHDIVMVVPIAGWFDPWGQGLQVTVSS

SEQ ID NO: 364 - protein, 12 aa, Artificial Sequence
  Description of Artificial Sequence: Synthetic peptide
GGEWGDSDYHWG

SEQ ID NO: 365 - protein, 16 aa, Artificial Sequence
  Description of Artificial Sequence: Synthetic peptide
SIHWRGTTHYNAPFRG

SEQ ID NO: 366 - protein, 18 aa, Artificial Sequence
  Description of Artificial Sequence: Synthetic peptide
HKYHDIVMVVPIAGWFDP

SEQ ID NO: 367 - protein, 13 aa, Artificial Sequence
  Description of Artificial Sequence: Synthetic peptide
GGSIRGGEWGDSD

SEQ ID NO: 368-371 - skipped (4 entries)

SEQ ID NO: 372 - protein, 11 aa, Artificial Sequence
  Description of Artificial Sequence: Synthetic peptide
RASQSVKNNLA

SEQ ID NO: 373 - protein, 7 aa, Artificial Sequence
  Description of Artificial Sequence: Synthetic peptide
DTSSRAS

SEQ ID NO: 374-377 - skipped (4 entries)

SEQ ID NO: 378 - protein, 5 aa, Artificial Sequence
  Description of Artificial Sequence: Synthetic peptide
NHDVH

SEQ ID NO: 379 - protein, 17 aa, Artificial Sequence
  Description of Artificial Sequence: Synthetic peptide
WMSHEGDKTGLAQKFQG

SEQ ID NO: 380 - protein, 31 aa, Artificial Sequence
  Description of Artificial Sequence: Synthetic polypeptide
GSKHRLRDYFLYNEYGPNYEEWGDYLATLDV

SEQ ID NO: 381 - protein, 6 aa, Artificial Sequence
  Description of Artificial Sequence: Synthetic peptide
GNSFSN

SEQ ID NO: 382 - protein, 10 aa, Artificial Sequence
  Description of Artificial Sequence: Synthetic peptide
WMSHEGDKTG

SEQ ID NO: 383 - DNA, 720 bp, Artificial Sequence
  Description of Artificial Sequence: Synthetic polynucleotide
atgaggctccctgctcagctcctggggctgctaatgctctgggtctctggatccggtgcggaggttgtcataactcagtctccactcttcctgcccgtcacccctggagaggcggcctccttgtcttgcaagtgcagccacagcctccaacattcaactggagccaactatttggcttggtacctgcagagaccagggcaaactccacgcctgttgatccatttggccactcatcgggcctccggggtccctgacagattcagtggcagtggatcaggcacagattttacacttaaaatcagtcgagtggagtctgacgatgttggaacttattattgcatgcagggtctgcacagtccctggacgttcggccaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 384 - DNA, 336 bp, Artificial Sequence
  Description of Artificial Sequence: Synthetic polynucleotide
gaggttgtcataactcagtctccactcttcctgcccgtcacccctggagaggcggcctccttgtcttgcaagtgcagccacagcctccaacattcaactggagccaactatttggcttggtacctgcagagaccagggcaaactccacgcctgttgatccatttggccactcatcgggcctccggggtccctgacagattcagtggcagtggatcaggcacagattttacacttaaaatcagtcgagtggagtctgacgatgttggaacttattattgcatgcagggtctgcacagtccctggacgttcggccaagggaccaaggtggagatcaaa

SEQ ID NO: 385 - protein, 239 aa, Artificial Sequence
  Description of Artificial Sequence: Synthetic polypeptide
MRLPAQLLGLLMLWVSGSGAEVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 112 aa, Artificial Sequence
  Description of Artificial Sequence: Synthetic polypeptide
EVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIK

SEQ ID NO: 387 - protein, 16 aa, Artificial Sequence
  Description of Artificial Sequence: Synthetic peptide
KCSHSLQHSTGANYLA

SEQ ID NO: 388 - protein, 7 aa, Artificial Sequence
  Description of Artificial Sequence: Synthetic peptide
LATHRAS

SEQ ID NO: 389 - protein, 9 aa, Artificial Sequence
  Description of Artificial Sequence: Synthetic peptide
MQGLHSPWT

SEQ ID NO: 390 - DNA, 693 bp, Artificial Sequence
  Description of Artificial Sequence: Synthetic polynucleotide
atggcctgggctctgctcctcctcaccctcctcactcagggcacaggggcctgggcccagtctgccctgactcagcctccctccgcgtccgggtctcctggacagtcaatcaccatctcctgcactggaaccagcaataactttgtctcctggtaccagcaacacgcaggcaaggcccccaagctcgtcatttatgacgtcaataagcgcccctcaggtgtccctgatcgtttctctggctccaagtctggcaacacggcctccctgaccgtctctggactccagactgacgatgaggctgtctattactgcggctcacttgtaggcaactgggatgtgattttcggcggagggaccaagttgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 391 - DNA, 315 bp, Artificial Sequence
  Description of Artificial Sequence: Synthetic polynucleotide
cagtctgccctgactcagcctccctccgcgtccgggtctcctggacagtcaatcaccatctcctgcactggaaccagcaataactttgtctcctggtaccagcaacacgcaggcaaggcccccaagctcgtcatttatgacgtcaataagcgcccctcaggtgtccctgatcgtttctctggctccaagtctggcaacacggcctccctgaccgtctctggactccagactgacgatgaggctgtctattactgcggctcacttgtaggcaactgggatgtgattttcggcggagggaccaagttgaccgtccta

SEQ ID NO: 392 - protein, 230 aa, Artificial Sequence
  Description of Artificial Sequence: Synthetic polypeptide
MAWALLLLTLLTQGTGAWAQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 393 - protein, 105 aa, Artificial Sequence
  Description of Artificial Sequence: Synthetic polypeptide
QSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVL

SEQ ID NO: 394 - DNA, 705 bp, Artificial Sequence
  Description of Artificial Sequence: Synthetic polynucleotide
atggaaaccccagctcagcttctcttcctcctgctactctggctcccagatactactggagaaataatgatgacgcagtctccagccatcctgtctgtgtctccaggagacagagccacactctcctgcagggccagtcagagtgtgaagaataatttagcctggtaccagaagagacctggccaggctcccagactcctcatctttgatacatccagcagggcctctggtatccctgccaggttcagtggcggtggttctgggacagagttcactctcaccgtcaacagcatgcagtctgaagactttgcgacttattactgtcagcaatatgaagagtggcctcggacgttcggccaggggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 395 - DNA, 321 bp, Artificial Sequence
  Description of Artificial Sequence: Synthetic polynucleotide
gaaataatgatgacgcagtctccagccatcctgtctgtgtctccaggagacagagccacactctcctgcagggccagtcagagtgtgaagaataatttagcctggtaccagaagagacctggccaggctcccagactcctcatctttgatacatccagcagggcctctggtatccctgccaggttcagtggcggtggttctgggacagagttcactctcaccgtcaacagcatgcagtctgaagactttgcgacttattactgtcagcaatatgaagagtggcctcggacgttcggccaggggaccaaggtggaaatcaaa

SEQ ID NO: 396 - protein, 234 aa, Artificial Sequence
  Description of Artificial Sequence: Synthetic polypeptide
METPAQLLFLLLLWLPDTTGEIMMTQSPAILSVSPGDRATLSCRASQSVKNNLAWYQKRPGQAPRLLIFDTSSRASGIPARFSGGGSGTEFTLTVNSMQSEDFATYYCQQYEEWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 397 - protein, 107 aa, Artificial Sequence
  Description of Artificial Sequence: Synthetic polypeptide
EIMMTQSPAILSVSPGDRATLSCRASQSVKNNLAWYQKRPGQAPRLLIFDTSSRASGIPARFSGGGSGTEFTLTVNSMQSEDFATYYCQQYEEWPRTFGQGTKVEIK

SEQ ID NO: 398 - DNA, 1470 bp, Artificial Sequence
  Description of Artificial Sequence: Synthetic polynucleotide
atggactggatttggaggatcctcttcttggtggcagcagctacaagtgcccactcccaggtgcagttggtgcagtctggggctgaagtgaagaagcctgggtcctcagtgaaggtctcctgcaaggcctctggaaacagtttcagtaatcatgatgtccactgggtacgacaggccactggacaggggcttgaatggatgggatggatgagtcatgagggtgataagacaggcttggcacaaaagtttcagggcagagtcaccatcacgagggacagtggcgcaagtacagtctacatggagttgcgcggcctgacagctgacgacacggccatttattattgtttgaccggctcaaaacatcgcctgcgagattattttctgtacaatgaatatggccccaattatgaagagtggggtgactaccttgcgactttggacgtctggggccatgggaccgcggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 399 - DNA, 420 bp, Artificial Sequence
  Description of Artificial Sequence: Synthetic polynucleotide
caggtgcagttggtgcagtctggggctgaagtgaagaagcctgggtcctcagtgaaggtctcctgcaaggcctctggaaacagtttcagtaatcatgatgtccactgggtacgacaggccactggacaggggcttgaatggatgggatggatgagtcatgagggtgataagacaggcttggcacaaaagtttcagggcagagtcaccatcacgagggacagtggcgcaagtacagtctacatggagttgcgcggcctgacagctgacgacacggccatttattattgtttgaccggctcaaaacatcgcctgcgagattattttctgtacaatgaatatggccccaattatgaagagtggggtgactaccttgcgactttggacgtctggggccatgggaccgcggtcaccgtctcgagc

SEQ ID NO: 400 - protein, 489 aa, Artificial Sequence
  Description of Artificial Sequence: Synthetic polypeptide
MDWIWRILFLVAAATSAHSQVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 140 aa, Artificial Sequence
  Description of Artificial Sequence: Synthetic polypeptide
QVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSS

SEQ ID NO: 402 - DNA, 1446 bp, Artificial Sequence
  Description of Artificial Sequence: Synthetic polynucleotide
atgaaacacctgtggttcttcctcctgctggtggcagctcccagatgggtcctatcccaggtgcagctgcaggagtcgggcccaggactggtgagaccttcggagaccctgtccgtcacctgcatcgtctctgggggctccatcagcaattactactggacttggatccgacagtccccaggaaagggactggagtggataggctatatttctgacagagaaacaacgacttacaatccctccctcaacagtcgagccgtcatatcacgagacacgtcgaaaaaccaattgtccctacaattacgttccgtcaccactgcggacacggccatctatttctgtgcgacagcgcgccgaggacagaggatttatggagtggtttcatttggagagttcttctactactactacatggacgtctggggcaaagggactgcggtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 403 - DNA, 396 bp, Artificial Sequence
  Description of Artificial Sequence: Synthetic polynucleotide
caggtgcagctgcaggagtcgggcccaggactggtgagaccttcggagaccctgtccgtcacctgcatcgtctctgggggctccatcagcaattactactggacttggatccgacagtccccaggaaagggactggagtggataggctatatttctgacagagaaacaacgacttacaatccctccctcaacagtcgagccgtcatatcacgagacacgtcgaaaaaccaattgtccctacaattacgttccgtcaccactgcggacacggccatctatttctgtgcgacagcgcgccgaggacagaggatttatggagtggtttcatttggagagttcttctactactactacatggacgtctggggcaaagggactgcggtcaccgtctcctca

SEQ ID NO: 404 - protein, 481 aa, Artificial Sequence
  Description of Artificial Sequence: Synthetic polypeptide
MKHLWFFLLLVAAPRWVLSQVQLQESGPGLVRPSETLSVTCIVSGGSISNYYWTWIRQSPGKGLEWIGYISDRETTTYNPSLNSRAVISRDTSKNQLSLQLRSVTTADTAIYFCATARRGQRIYGVVSFGEFFYYYYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 132 aa, Artificial Sequence
  Description of Artificial Sequence: Synthetic polypeptide
QVQLQESGPGLVRPSETLSVTCIVSGGSISNYYWTWIRQSPGKGLEWIGYISDRETTTYNPSLNSRAVISRDTSKNQLSLQLRSVTTADTAIYFCATARRGQRIYGVVSFGEFFYYYYMDVWGKGTAVTVSS

SEQ ID NO: 406 - protein, 5 aa, Artificial Sequence
  Description of Artificial Sequence: Synthetic peptide
NYYWT

SEQ ID NO: 407 - protein, 16 aa, Artificial Sequence
  Description of Artificial Sequence: Synthetic peptide
YISDRETTTYNPSLNS

SEQ ID NO: 408 - protein, 24 aa, Artificial Sequence
  Description of Artificial Sequence: Synthetic peptide
ARRGQRIYGVVSFGEFFYYYYMDV

SEQ ID NO: 409 - protein, 6 aa, Artificial Sequence
  Description of Artificial Sequence: Synthetic peptide
GGSISN

SEQ ID NO: 410 - protein, 9 aa, Artificial Sequence
  Description of Artificial Sequence: Synthetic peptide
YISDRETTT

SEQ ID NO: 411 - DNA, 702 bp, Artificial Sequence
  Description of Artificial Sequence: Synthetic polynucleotide
atggcctggatccctctcctcctcggcctcctctctcactgcacagggtctgtgacgtcctatgtgagcccactgtcagtggccctgggggagacggccaggatttcctgtggacgacaggcccttggaagtagagctgtgcagtggtatcaacataagccaggccaggcccctattttgctcatctataataatcaagaccggccctcagggatccctgagcggttctctggcacccctgatattaattttgggaccacggccaccctgactatcagcggggtcgaagtcggggatgaagccgactattactgtcacatgtgggactctagaagtggtttcagttggtctttcggcggggcgaccaggctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacaaaagctacagctgccaggtcacgcatgaagggagcaccgtggagaagacagtggcccctacagaatgttcatag

SEQ ID NO: 412 - DNA, 324 bp, Artificial Sequence
  Description of Artificial Sequence: Synthetic polynucleotide
tcctatgtgagcccactgtcagtggccctgggggagacggccaggatttcctgtggacgacaggcccttggaagtagagctgtgcagtggtatcaacataagccaggccaggcccctattttgctcatctataataatcaagaccggccctcagggatccctgagcggttctctggcacccctgatattaattttgggaccacggccaccctgactatcagcggggtcgaagtcggggatgaagccgactattactgtcacatgtgggactctagaagtggtttcagttggtctttcggcggggcgaccaggctgaccgtccta

SEQ ID NO: 413 - protein, 233 aa, Artificial Sequence
  Description of Artificial Sequence: Synthetic polypeptide
MAWIPLLLGLLSHCTGSVTSYVSPLSVALGETARISCGRQALGSRAVQWYQHKPGQAPILLIYNNQDRPSGIPERFSGTPDINFGTTATLTISGVEVGDEADYYCHMWDSRSGFSWSFGGATRLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 414 - protein, 108 aa, Artificial Sequence
  Description of Artificial Sequence: Synthetic polypeptide
SYVSPLSVALGETARISCGRQALGSRAVQWYQHKPGQAPILLIYNNQDRPSGIPERFSGTPDINFGTTATLTISGVEVGDEADYYCHMWDSRSGFSWSFGGATRLTVL

SEQ ID NO: 415 - protein, 11 aa, Artificial Sequence
  Description of Artificial Sequence: Synthetic peptide
GRQALGSRAVQ

SEQ ID NO: 416 - protein, 12 aa, Artificial Sequence
  Description of Artificial Sequence: Synthetic peptide
HMWDSRSGFSWS

SEQ ID NO: 417 - DNA, 1446 bp, Artificial Sequence
  Description of Artificial Sequence: Synthetic polynucleotide
atgaaacacctgtggttcttccttctcctggtggcagctcccagatgggtcgtgtcccaggtgcatctgcaagagtcggggccaggactggtgacgccttcggaaaccctgtccctcacttgcactgtgtcgaatggctccgtcagtggtcgcttctggagctggatccggcagtccccagggagaggactggaatggatcggttatttttctgacactgacaggtctgaatataatccttctctcaggagtcgactcaccttatcagtagatagatctaagaaccagttgtccctgagattgaagtccgtgaccgctgcggattcggccacttattactgtgcgagagcacagcaggggaagaggatctatggaatagtgtctttcggagagttcttctattattattacatggacgcctggggcaaagggactccggtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 418 - DNA, 396 bp, Artificial Sequence
  Description of Artificial Sequence: Synthetic polynucleotide
caggtgcatctgcaagagtcggggccaggactggtgacgccttcggaaaccctgtccctcacttgcactgtgtcgaatggctccgtcagtggtcgcttctggagctggatccggcagtccccagggagaggactggaatggatcggttatttttctgacactgacaggtctgaatataatccttctctcaggagtcgactcaccttatcagtagatagatctaagaaccagttgtccctgagattgaagtccgtgaccgctgcggattcggccacttattactgtgcgagagcacagcaggggaagaggatctatggaatagtgtctttcggagagttcttctattattattacatggacgcctggggcaaagggactccggtcaccgtctcctca

SEQ ID NO: 419 - protein, 481 aa, Artificial Sequence
  Description of Artificial Sequence: Synthetic polypeptide
MKHLWFFLLLVAAPRWVVSQVHLQESGPGLVTPSETLSLTCTVSNGSVSGRFWSWIRQSPGRGLEWIGYFSDTDRSEYNPSLRSRLTLSVDRSKNQLSLRLKSVTAADSATYYCARAQQGKRIYGIVSFGEFFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - protein, 132 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLRLKSVTAADSATYYCARAQQGKRIYGIVSFGEFFYYYYMDAWGKGTPVTVSS

SEQ ID NO: 421 - protein, 5 aa, Artificial Sequence
  Description of Artificial Sequence: Synthetic peptide
GRFWS

SEQ ID NO: 422 - protein, 16 aa, Artificial Sequence
  Description of Artificial Sequence: Synthetic peptide
YFSDTDRSEYNPSLRS

SEQ ID NO: 423 - protein, 24 aa, Artificial Sequence
  Description of Artificial Sequence: Synthetic peptide
AQQGKRIYGIVSFGEFFYYYYMDA

SEQ ID NO: 424 - protein, 6 aa, Artificial Sequence
  Description of Artificial Sequence: Synthetic peptide
NGSVSG

SEQ ID NO: 425 - protein, 9 aa, Artificial Sequence
  Description of Artificial Sequence: Synthetic peptide
YFSDTDRSE

SEQ ID NO: 426 - DNA, 699 bp, Artificial Sequence
  Description of Artificial Sequence: Synthetic polynucleotide
atggcctggatccctctcctcctcggcctcctctctcactgcacaggttctgacacttcgttaaacccactgtcgctggccccaggagcgacggccaaaattccctgcggagaaaggagccgtggaagtagggctgtccagtggtatcagcagaagccaggccaggcccccacattgatcatttataataatcaagaccggcccgcaggggtctctgaacgattttctggcaatcctgacgtcgctattggggtgacggccaccctgaccatcagtcgggtcgaagtcggggatgaggccgactattattgtcactattgggacagtagaagtcccatcagctggattttcggcggagggacccagctgaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacaaaagctacagctgccaggtcacgcatgaagggagcaccgtggagaagacagtggcccctacagaatgttcatag

SEQ ID NO: 427 - DNA, 321 bp, Artificial Sequence
  Description of Artificial Sequence: Synthetic polynucleotide
tcgttaaacccactgtcgctggccccaggagcgacggccaaaattccctgcggagaaaggagccgtggaagtagggctgtccagtggtatcagcagaagccaggccaggcccccacattgatcatttataataatcaagaccggcccgcaggggtctctgaacgattttctggcaatcctgacgtcgctattggggtgacggccaccctgaccatcagtcgggtcgaagtcggggatgaggccgactattattgtcactattgggacagtagaagtcccatcagctggattttcggcggagggacccagctgaccgtcctg

SEQ ID NO: 428 - protein, 232 aa, Artificial Sequence
  Description of Artificial Sequence: Synthetic polypeptide
MAWIPLLLGLLSHCTGSDTSLNPLSLAPGATAKIPCGERSRGSRAVQWYQQKPGQAPTLIIYNNQDRPAGVSERFSGNPDVAIGVTATLTISRVEVGDEADYYCHYWDSRSPISWIFGGGTQLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 429 - protein, 107 aa, Artificial Sequence
  Description of Artificial Sequence: Synthetic polypeptide
SLNPLSLAPGATAKIPCGERSRGSRAVQWYQQKPGQAPTLIIYNNQDRPAGVSERFSGNPDVAIGVTATLTISRVEVGDEADYYCHYWDSRSPISWIFGGGTQLTVL

SEQ ID NO: 430 - protein, 11 aa, Artificial Sequence
  Description of Artificial Sequence: Synthetic peptide
GERSRGSRAVQ

SEQ ID NO: 431 - protein, 12 aa, Artificial Sequence
  Description of Artificial Sequence: Synthetic peptide
HYWDSRSPISWI

SEQ ID NO: 432 - DNA, 1446 bp, Artificial Sequence
  Description of Artificial Sequence: Synthetic polynucleotide
atgaaacacctgtggttcttcctcctgctggtggcagctcccagatgggtcgtgtcccaggtgcatctgcaagagtcggggccaggactggtgacgccttcggaaaccctgtccctcacttgcactgtgtcgaatggctccgtcagtggtcgcttctggagctggatccggcagtccccagggagaggactggaatggatcggttatttttctgacactgacaggtctgaatataatccttctctcaggagtcgactcaccttatcagtcgatagatccaagaaccagttgtccctaaaattgaagtccgtgaccgctgcggattcggccacttattactgtgcgagagcacaacaggggaagaggatctatggaatagtgtctttcggagagttgttctattattattacatggacgcctggggcaaagggactccggtcaccgtctcctcagcgtcgaccaagggcccatcggtcttccctctggcaccatcatccaagtcgacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 433 - DNA, 396 bp, Artificial Sequence
  Description of Artificial Sequence: Synthetic polynucleotide
caggtgcatctgcaagagtcggggccaggactggtgacgccttcggaaaccctgtccctcacttgcactgtgtcgaatggctccgtcagtggtcgcttctggagctggatccggcagtccccagggagaggactggaatggatcggttatttttctgacactgacaggtctgaatataatccttctctcaggagtcgactcaccttatcagtcgatagatccaagaaccagttgtccctaaaattgaagtccgtgaccgctgcggattcggccacttattactgtgcgagagcacaacaggggaagaggatctatggaatagtgtctttcggagagttgttctattattattacatggacgcctggggcaaagggactccggtcaccgtctcctca

SEQ ID NO: 434 - protein, 481 aa, Artificial Sequence
  Description of Artificial Sequence: Synthetic polypeptide
MKHLWFFLLLVAAPRWVVSQVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 435 - protein, 132 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSS

SEQ ID NO: 436 - protein, 24 aa, Artificial Sequence
  Description of Artificial Sequence: Synthetic peptide
AQQGKRIYGIVSFGELFYYYYMDA

SEQ ID NO: 437 - DNA, 699 bp, Artificial Sequence
  Description of Artificial Sequence: Synthetic polynucleotide
atggcctggatccctctcctcctcggcctcctctctcactgcacaggttctgacacttcgttaaacccactgtcgctggccccgggagcgacggccaaaattccctgcggagaaaggagccgtggaagtagggctgtccagtggtatcagcagaagccaggccaggcccccacattgatcatttataataatcaagaccggcccgcaggggtctctgaacgattttctggcaatcctgacgtcgctattggggtgacggccaccctgaccatcagtcgggtcgaagtcggggatgagggcgactattattgtcactattgggacagtagaagtcccatcagctggattttcgccggagggacccagttgaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacaaaagctacagctgccaggtcacgcatgaagggagcaccgtggagaagacagtggcccctacagaatgttcatag

SEQ ID NO: 438 - DNA, 321 bp, Artificial Sequence
  Description of Artificial Sequence: Synthetic polynucleotide
tcgttaaacccactgtcgctggccccgggagcgacggccaaaattccctgcggagaaaggagccgtggaagtagggctgtccagtggtatcagcagaagccaggccaggcccccacattgatcatttataataatcaagaccggcccgcaggggtctctgaacgattttctggcaatcctgacgtcgctattggggtgacggccaccctgaccatcagtcgggtcgaagtcggggatgagggcgactattattgtcactattgggacagtagaagtcccatcagctggattttcgccggagggacccagttgaccgtcctg

SEQ ID NO: 439 - protein, 232 aa, Artificial Sequence
  Description of Artificial Sequence: Synthetic polypeptide
MAWIPLLLGLLSHCTGSDTSLNPLSLAPGATAKIPCGERSRGSRAVQWYQQKPGQAPTLIIYNNQDRPAGVSERFSGNPDVAIGVTATLTISRVEVGDEGDYYCHYWDSRSPISWIFAGGTQLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 440 - protein, 107 aa, Artificial Sequence
  Description of Artificial Sequence: Synthetic polypeptide
SLNPLSLAPGATAKIPCGERSRGSRAVQWYQQKPGQAPTLIIYNNQDRPAGVSERFSGNPDVAIGVTATLTISRVEVGDEGDYYCHYWDSRSPISWIFAGGTQLTVL

SEQ ID NO: 441 - DNA, 1437 bp, Artificial Sequence
  Description of Artificial Sequence: Synthetic polynucleotide
atgaaacacctgtggttcttcctcctgctggtggcagctcccagatgggtcctttcccaggtgcaactacaggagtcgggcccaggactggtgaagccttcggagaccctttccctcacctgcactgtctctggtgactccatcaacactggtcatcactactggggctgggtccgtcaggtcccagggaagggaccggaatggattgctcacatccactataatacggctgtcttgcacaatccggccctcaagagtcgagtcaccatttcgattttcaccctgaagaatctgattaccctgaggctcagtaatatgaccgccgcggacacggccgtctatttctgcgttcgatccggcggcgacattttatactataatgagtggcaaaaaccccactggttctatccctggggcccgggaattttggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 442 - DNA, 387 bp, Artificial Sequence
  Description of Artificial Sequence: Synthetic polynucleotide
caggtgcaactacaggagtcgggcccaggactggtgaagccttcggagaccctttccctcacctgcactgtctctggtgactccatcaacactggtcatcactactggggctgggtccgtcaggtcccagggaagggaccggaatggattgctcacatccactataatacggctgtcttgcacaatccggccctcaagagtcgagtcaccatttcgattttcaccctgaagaatctgattaccctgaggctcagtaatatgaccgccgcggacacggccgtctatttctgcgttcgatccggcggcgacattttatactataatgagtggcaaaaaccccactggttctatccctggggcccgggaattttggtcaccgtctcgagc

SEQ ID NO: 443 - protein, 478 aa, Artificial Sequence
  Description of Artificial Sequence: Synthetic polypeptide
MKHLWFFLLLVAAPRWVLSQVQLQESGPGLVKPSETLSLTCTVSGDSINTGHHYWGWVRQVPGKGPEWIAHIHYNTAVLHNPALKSRVTISIFTLKNLITLRLSNMTAADTAVYFCVRSGGDILYYNEWQKPHWFYPWGPGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 444 - protein, 129 aa, Artificial Sequence
  Description of Artificial Sequence: Synthetic polypeptide
QVQLQESGPGLVKPSETLSLTCTVSGDSINTGHHYWGWVRQVPGKGPEWIAHIHYNTAVLHNPALKSRVTISIFTLKNLITLRLSNMTAADTAVYFCVRSGGDILYYNEWQKPHWFYPWGPGILVTVSS

SEQ ID NO: 445 - protein, 19 aa, Artificial Sequence
  Description of Artificial Sequence: Synthetic peptide
SGGDILYYNEWQKPHWFYP

SEQ ID NO: 446 - DNA, 708 bp, Artificial Sequence
  Description of Artificial Sequence: Synthetic polynucleotide
atggcctgggctctgctcctcctcaccctcctcactcagggcacagggtcctgggcccagtctgccctgactcagcctccctccgcgtccgggtctcttggacagtcactcaccatctcctgcagtggaaccgccagtgacattggcagttggaattttgtctcctggtatcaacaattcccaggcagagcccccaacctcattatttttgaggtcaataggcggcgatcaggggtccctgatcgcttctctggttccaagtcgggcaatacggcctccctgaccgtctctgggctccggtctgaggatgaggctgaatatttttgcagttccctttcaggcaggtgggacattgtttttggcggagggaccaaggtgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 447 - DNA, 330 bp, Artificial Sequence
  Description of Artificial Sequence: Synthetic polynucleotide
cagtctgccctgactcagcctccctccgcgtccgggtctcttggacagtcactcaccatctcctgcagtggaaccgccagtgacattggcagttggaattttgtctcctggtatcaacaattcccaggcagagcccccaacctcattatttttgaggtcaataggcggcgatcaggggtccctgatcgcttctctggttccaagtcgggcaatacggcctccctgaccgtctctgggctccggtctgaggatgaggctgaatatttttgcagttccctttcaggcaggtgggacattgtttttggcggagggaccaaggtgaccgtccta

SEQ ID NO: 448 - protein, 235 aa, Artificial Sequence
  Description of Artificial Sequence: Synthetic polypeptide
MAWALLLLTLLTQGTGSWAQSALTQPPSASGSLGQSLTISCSGTASDIGSWNFVSWYQQFPGRAPNLIIFEVNRRRSGVPDRFSGSKSGNTASLTVSGLRSEDEAEYFCSSLSGRWDIVFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 449 - protein, 110 aa, Artificial Sequence
  Description of Artificial Sequence: Synthetic polypeptide
QSALTQPPSASGSLGQSLTISCSGTASDIGSWNFVSWYQQFPGRAPNLIIFEVNRRRSGVPDRFSGSKSGNTASLTVSGLRSEDEAEYFCSSLSGRWDIVFGGGTKVTVL

SEQ ID NO: 450 - protein, 14 aa, Artificial Sequence
  Description of Artificial Sequence: Synthetic peptide
SGTASDIGSWNFVS

SEQ ID NO: 451 - DNA, 1455 bp, Artificial Sequence
  Description of Artificial Sequence: Synthetic polynucleotide
atgaaacacctgtggttcttcctcctgctggtggcagctcccagatgggtcctgtcccagccgcagctgcaggagtcggggccaggactggtggaggcttcggagaccctgtccctcacctgcactgtgtccggcgactccactgctgcttgtgactatttctggggctgggtccggcagcccccagggaaggggctggagtggattggaagtttgtcacattgtgcaggttactacaatagtggctggacctaccacaacccgtctctcaagagtcgactcacgatttcactcgacacgcccaagaatcaggtcttcctgaagttaaattctgtgaccgccgcggacacggccatttactactgtgcgcgattcggtggcgacgttttggtgtaccacgattggccaaagccggcctgggtcgacctctggggccggggagttttggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 452 - DNA, 405 bp, Artificial Sequence
  Description of Artificial Sequence: Synthetic polynucleotide
cagccgcagctgcaggagtcggggccaggactggtggaggcttcggagaccctgtccctcacctgcactgtgtccggcgactccactgctgcttgtgactatttctggggctgggtccggcagcccccagggaaggggctggagtggattggaagtttgtcacattgtgcaggttactacaatagtggctggacctaccacaacccgtctctcaagagtcgactcacgatttcactcgacacgcccaagaatcaggtcttcctgaagttaaattctgtgaccgccgcggacacggccatttactactgtgcgcgattcggtggcgacgttttggtgtaccacgattggccaaagccggcctgggtcgacctctggggccggggagttttggtcaccgtctcgagc

SEQ ID NO: 453 - protein, 484 aa, Artificial Sequence [sequence omitted]

SEQ ID NO: 454 - protein, 135 aa, Artificial Sequence
  Description of Artificial Sequence: Synthetic polypeptide
QPQLQESGPGLVEASETLSLTCTVSGDSTAACDYFWGWVRQPPGKGLEWIGSLSHCAGYYNSGWTYHNPSLKSRLTISLDTPKNQVFLKLNSVTAADTAIYYCARFGGDVLVYHDWPKPAWVDLWGRGVLVTVSS

SEQ ID NO: 455 - protein, 22 aa, Artificial Sequence
  Description of Artificial Sequence: Synthetic peptide
SLSHCAGYYNSGWTYHNPSLKS

SEQ ID NO: 456 - protein, 19 aa, Artificial Sequence
  Description of Artificial Sequence: Synthetic peptide
FGGDVLVYHDWPKPAWVDL

SEQ ID NO: 457 - protein, 15 aa, Artificial Sequence
  Description of Artificial Sequence: Synthetic peptide
SLSHCAGYYNSGWTY

SEQ ID NO: 458 - protein, 9 aa, Artificial Sequence
  Description of Artificial Sequence: Synthetic peptide
TGNINNFVS

SEQ ID NO: 459 - protein, 10 aa, Artificial Sequence
  Description of Artificial Sequence: Synthetic peptide
GSLAGNWDVV

SEQ ID NO: 460 - DNA, 1455 bp, Artificial Sequence
  Description of Artificial Sequence: Synthetic polynucleotide
atgaaacacctgtggttcttcctcctgctggtggcagctcccagatgggtcctgtcccagccgcagctgcaggagtcggggccaggactggtggaggcttcggagaccctgtccctcacctgcactgtgtccggcgactccactgctggttgtgactatttctggggctgggtccggcagcccccagggaaggggctggagtggattgggggtttgtcacattgtgcaggttactacaatactggctggacctaccacaacccgtctctcaagagtcgactcacgatttcactcgacacgcccaagaatcaggtcttcctgaagttaaattctgtgaccgccgcggacacggccatttactactgtgcgcgattcgacggcgaagttttggtgtacaacgattggccaaagccggcctgggtcgacctctggggccggggaactttggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 461 - DNA, 405 bp, Artificial Sequence
  Description of Artificial Sequence: Synthetic polynucleotide
cagccgcagctgcaggagtcggggccaggactggtggaggcttcggagaccctgtccctcacctgcactgtgtccggcgactccactgctggttgtgactatttctggggctgggtccggcagcccccagggaaggggctggagtggattgggggtttgtcacattgtgcaggttactacaatactggctggacctaccacaacccgtctctcaagagtcgactcacgatttcactcgacacgcccaagaatcaggtcttcctgaagttaaattctgtgaccgccgcggacacggccatttactactgtgcgcgattcgacggcgaagttttggtgtacaacgattggccaaagccggcctgggtcgacctctggggccggggaactttggtcaccgtctcgagc

SEQ ID NO: 462 - protein, 484 aa, Artificial Sequence
  Description of Artificial Sequence: Synthetic polypeptide
MKHLWFFLLLVAAPRWVLSQPQLQESGPGLVEASETLSLTCTVSGDSTAGCDYFWGWVRQPPGKGLEWIGGLSHCAGYYNTGWTYHNPSLKSRLTISLDTPKNQVFLKLNSVTAADTAIYYCARFDGEVLVYNDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 463 - protein, 135 aa, Artificial Sequence
  Description of Artificial Sequence: Synthetic polypeptide
QPQLQESGPGLVEASETLSLTCTVSGDSTAGCDYFWGWVRQPPGKGLEWIGGLSHCAGYYNTGWTYHNPSLKSRLTISLDTPKNQVFLKLNSVTAADTAIYYCARFDGEVLVYNDWPKPAWVDLWGRGTLVTVSS

SEQ ID NO: 464 - protein, 7 aa, Artificial Sequence
  Description of Artificial Sequence: Synthetic peptide
GCDYFWG

SEQ ID NO: 465 - protein, 19 aa, Artificial Sequence
  Description of Artificial Sequence: Synthetic peptide
FDGEVLVYNDWPKPAWVDL

SEQ ID NO: 466 - protein, 8 aa, Artificial Sequence
  Description of Artificial Sequence: Synthetic peptide
GDSTAGCD

SEQ ID NO: 467 - DNA, 693 bp, Artificial Sequence
  Description of Artificial Sequence: Synthetic polynucleotide
atggcctgggctctgctcctcctcaccctcctcactcagggcacaggggcctgggcccagtctgccctgactcagcctccctccgcgtccgggtctcctggacagtcaatcaccatctcctgcactggaaccagcaataactttgtctcctggtaccagcaacacccagccaaggcccccaaactcgtcatttatggggtcaataagcgcccctcaggtgtccctgatcgtttttctggctccaagtctggcaacacggcctccctgaccgtctctggactccagactgacgatgaggctgtctattactgcggctcacttgtaggcaactgggatgtgattttcggcggagggaccaagttgaccgtcctgggtcagcccatggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 468 - DNA, 315 bp, Artificial Sequence
  Description of Artificial Sequence: Synthetic polynucleotide
cagtctgccctgactcagcctccctccgcgtccgggtctcctggacagtcaatcaccatctcctgcactggaaccagcaataactttgtctcctggtaccagcaacacccagccaaggcccccaaactcgtcatttatggggtcaataagcgcccctcaggtgtccctgatcgtttttctggctccaagtctggcaacacggcctccctgaccgtctctggactccagactgacgatgaggctgtctattactgcggctcacttgtaggcaactgggatgtgattttcggcggagggaccaagttgaccgtcctg

SEQ ID NO: 469 - protein, 230 aa, Artificial Sequence
  Description of Artificial Sequence: Synthetic polypeptide
MAWALLLLTLLTQGTGAWAQSALTQPPSASGSPGQSITISCTGTSNNFVSWYQQHPAKAPKLVIYGVNKRPSGVPDRFSGSKSGNTASLTVSGLQTDDEAVYYCGSLVGNWDVIFGGGTKLTVLGQPMAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 470 - protein, 105 aa, Artificial Sequence
  Description of Artificial Sequence: Synthetic polypeptide
QSALTQPPSASGSPGQSITISCTGTSNNFVSWYQQHPAKAPKLVIYGVNKRPSGVPDRFSGSKSGNTASLTVSGLQTDDEAVYYCGSLVGNWDVIFGGGTKLTVL

SEQ ID NO: 471 - DNA, 1455 bp, Artificial Sequence
  Description of Artificial Sequence: Synthetic polynucleotide
atggaattggggctgagctgggttttcctcgttggtctcttaagaggtgtccagtgtcgggtgcagttggtggagtcggggggaggcgtggtccagcctgggaagtccgtgagactttcctgtgtagtctccgatttccccttcagcaagtatcctatgtattgggttcgccaggctccaggcaaggggctggagtgggtggcagccatctccggtgatgcctggcatgtggtctactcaaattccgtgcagggccgatttctcgtctccagggacaatgtcaagaacactctatatttagaaatgaacagcctgaaaattgaggatacggccgtatatcgctgcgcgagaatgttccaggagtctggtccaccacgtttggatcgttggagcggtcgaaattattactattattctggtatggacgtctggggccaagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 472 - DNA, 405 bp, Artificial Sequence
  Description of Artificial Sequence: Synthetic polynucleotide
cgggtgcagttggtggagtcggggggaggcgtggtccagcctgggaagtccgtgagactttcctgtgtagtctccgatttccccttcagcaagtatcctatgtattgggttcgccaggctccaggcaaggggctggagtgggtggcagccatctccggtgatgcctggcatgtggtctactcaaattccgtgcagggccgatttctcgtctccagggacaatgtcaagaacactctatatttagaaatgaacagcctgaaaattgaggatacggccgtatatcgctgcgcgagaatgttccaggagtctggtccaccacgtttggatcgttggagcggtcgaaattattactattattctggtatggacgtctggggccaagggaccacggtcaccgtctcgagc

SEQ ID NO: 473 - protein, 484 aa, Artificial Sequence
  Description of Artificial Sequence: Synthetic polypeptide
MELGLSWVFLVGLLRGVQCRVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 474 - protein, 135 aa, Artificial Sequence
  Description of Artificial Sequence: Synthetic polypeptide
RVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYYSGMDVWGQGTTVTVSS

SEQ ID NO: 475 - protein, 5 aa, Artificial Sequence
  Description of Artificial Sequence: Synthetic peptide
KYPMY

SEQ ID NO: 476 - protein, 17 aa, Artificial Sequence
  Description of Artificial Sequence: Synthetic peptide
AISGDAWHVVYSNSVQG

SEQ ID NO: 477 - protein, 26 aa, Artificial Sequence
  Description of Artificial Sequence: Synthetic peptide
MFQESGPPRLDRWSGRNYYYYSGMDV

SEQ ID NO: 478 - protein, 6 aa, Artificial Sequence
  Description of Artificial Sequence: Synthetic peptide
DFPFSK

SEQ ID NO: 479 - protein, 10 aa, Artificial Sequence
  Description of Artificial Sequence: Synthetic peptide
AISGDAWHVV

SEQ ID NO: 480 - DNA, 720 bp, Artificial Sequence
  Description of Artificial Sequence: Synthetic polynucleotide
atgaggctccctgctcagctcctggggctgctaatgctctggatacctgaattcactgcagacattgtgatgacccagactcctctctctttgtccgtcacccctggacagccggcctccatctcctgcaagtccagtgagagcctccgacaaagtaatggaaagacctctttgtattggtatcggcagaagccaggccagtctccacaactcctagtgtttgaagtttctaatcgattctctggcgtgtcggataggtttgttggcagcgggtcagggacagacttcacactgagaatcagccgggtagaggctgaggatgttggattttattactgcatgcaaagtaaagacttcccacttacatttggcggcgggaccaaggtggatctcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 481 - DNA, 336 bp, Artificial Sequence
  Description of Artificial Sequence: Synthetic polynucleotide
gacattgtgatgacccagactcctctctctttgtccgtcacccctggacagccggcctccatctcctgcaagtccagtgagagcctccgacaaagtaatggaaagacctctttgtattggtatcggcagaagccaggccagtctccacaactcctagtgtttgaagtttctaatcgattctctggcgtgtcggataggtttgttggcagcgggtcagggacagacttcacactgagaatcagccgggtagaggctgaggatgttggattttattactgcatgcaaagtaaagacttcccacttacatttggcggcgggaccaaggtggatctcaaa

SEQ ID NO: 482 - protein, 239 aa, Artificial Sequence [sequence omitted]

SEQ ID NO: 483 - protein, 112 aa, Artificial Sequence
  Description of Artificial Sequence: Synthetic polypeptide
DIVMTQTPLSLSVTPGQPASISCKSSESLRQSNGKTSLYWYRQKPGQSPQLLVFEVSNRFSGVSDRFVGSGSGTDFTLRISRVEAEDVGFYYCMQSKDFPLTFGGGTKVDLK

SEQ ID NO: 484 - protein, 16 aa, Artificial Sequence
  Description of Artificial Sequence: Synthetic peptide
KSSESLRQSNGKTSLY

SEQ ID NO: 485 - protein, 7 aa, Artificial Sequence
  Description of Artificial Sequence: Synthetic peptide
EVSNRFS

SEQ ID NO: 486 - protein, 9 aa, Artificial Sequence
  Description of Artificial Sequence: Synthetic peptide
MQSKDFPLT

SEQ ID NO: 487 - DNA, 1455 bp, Artificial Sequence
  Description of Artificial Sequence: Synthetic polynucleotide
atggaattggggctgagctgggttttcctcgttggtctcttaagaggtgtccactgtcgggtgcagttggtggagtcggggggaggcgtggtccagcctgggaagtccgtgagactttcctgtgtagtctctgatttccccttcagcaagtatcctatgtattgggttcgccaggctccaggcaaggggctggagtgggtggcagccatctccgctgatgcctggcatgtggtctactcaggctccgtgcagggccgatttctcgtctccagggacaactccaagaacattctgtatttggaaatgaacaccctgaaaattgaggacacggccgtatatcgctgcgcgagaatgttccaggagtctggtccaccacgtttcgattcttggagcggtcgaaattactactattactctggtatggacgtctggggccaagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 488 - DNA, 405 bp, Artificial Sequence
  Description of Artificial Sequence: Synthetic polynucleotide
cgggtgcagttggtggagtcggggggaggcgtggtccagcctgggaagtccgtgagactttcctgtgtagtctctgatttccccttcagcaagtatcctatgtattgggttcgccaggctccaggcaaggggctggagtgggtggcagccatctccgctgatgcctggcatgtggtctactcaggctccgtgcagggccgatttctcgtctccagggacaactccaagaacattctgtatttggaaatgaacaccctgaaaattgaggacacggccgtatatcgctgcgcgagaatgttccaggagtctggtccaccacgtttcgattcttggagcggtcgaaattactactattactctggtatggacgtctggggccaagggaccacggtcaccgtctcgagc

SEQ ID NO: 489 - protein, 484 aa, Artificial Sequence
  Description of Artificial Sequence: Synthetic polypeptide
MELGLSWVFLVGLLRGVHCRVQLVESGGGVVQPGKSVRLSCVVSDFPFSKYPMYWVRQAPGKGLEWVAAISADAWHVVYSGSVQGRFLVSRDNSKNILYLEMNTLKIEDTAVYRCARMFQESGPPRFDSWSGRNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - protein, 135 aa, Artificial Sequence
  Description of Artificial Sequence: Synthetic polypeptide
RVQLVESGGGVVQPGKSVRLSCVVSDFPFSKYPMYWVRQAPGKGLEWVAAISADAWHVVYSGSVQGRFLVSRDNSKNILYLEMNTLKIEDTAVYRCARMFQESGPPRFDSWSGRNYYYYSGMDVWGQGTTVTVSS

SEQ ID NO: 491 - protein, 17 aa, Artificial Sequence
  Description of Artificial Sequence: Synthetic peptide
AISADAWHVVYSGSVQG

SEQ ID NO: 492 - protein, 26 aa, Artificial Sequence
  Description of Artificial Sequence: Synthetic peptide
MFQESGPPRFDSWSGRNYYYYSGMDV

SEQ ID NO: 493 - protein, 10 aa, Artificial Sequence
  Description of Artificial Sequence: Synthetic peptide
AISADAWHVV

SEQ ID NO: 494 - DNA, 720 bp, Artificial Sequence
  Description of Artificial Sequence: Synthetic polynucleotide
atgaggctccctgctcagctcctggggctgctaatgctctggatacctgaatttattgccgacattgtgatgacccagactcctctctctttgtccgtcgaccctggacagccggcctccatctcctgcaagtccagtcagagcctccgacaaagtaatggaaagacctctttgtattggtatcagcagaagccaggccagtctccacaactcctaatatttgaagtttctaatcgattctctggcgtgtcggataggtttgttggcagcgggtcagggacagacttcacactgagaatcagccgggtagaggctgaggatgttggattttattactgcatgcaaagtaaagacttcccactcacctttggcggcgggaccaaggtggatctcaaccgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 495 - DNA, 336 bp, Artificial Sequence
  Description of Artificial Sequence: Synthetic polynucleotide
gacattgtgatgacccagactcctctctctttgtccgtcgaccctggacagccggcctccatctcctgcaagtccagtcagagcctccgacaaagtaatggaaagacctctttgtattggtatcagcagaagccaggccagtctccacaactcctaatatttgaagtttctaatcgattctctggcgtgtcggataggtttgttggcagcgggtcagggacagacttcacactgagaatcagccgggtagaggctgaggatgttggattttattactgcatgcaaagtaaagacttcccactcacctttggcggcgggaccaaggtggatctcaac

SEQ ID NO: 496 - protein, 239 aa, Artificial Sequence
  Description of Artificial Sequence: Synthetic polypeptide
MRLPAQLLGLLMLWIPEFIADIVMTQTPLSLSVDPGQPASISCKSSQSLRQSNGKTSLYWYQQKPGQSPQLLIFEVSNRFSGVSDRFVGSGSGTDFTLRISRVEAEDVGFYYCMQSKDFPLTFGGGTKVDLNRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 497 - protein, 112 aa, Artificial Sequence
  Description of Artificial Sequence: Synthetic polypeptide
DIVMTQTPLSLSVDPGQPASISCKSSQSLRQSNGKTSLYWYQQKPGQSPQLLIFEVSNRFSGVSDRFVGSGSGTDFTLRISRVEAEDVGFYYCMQSKDFPLTFGGGTKVDLN

SEQ ID NO: 498 - protein, 16 aa, Artificial Sequence
  Description of Artificial Sequence: Synthetic peptide
KSSQSLRQSNGKTSLY

SEQ ID NO: 499 - DNA, 1455 bp, Artificial Sequence
  Description of Artificial Sequence: Synthetic polynucleotide
atggaattggggctgagctgggttttcctcgttgctctcttaagaggtgtccagtgtcaggtgcagttggtggagtcgggcggaggcgtggtccagcctgggaagtccctgagactctcctgtgtagtctctaattttctcttcaataaacgtcacatgcactgggtccgccaggctccaggcaagggactagagtggatagcagtcatttcctctgatgccattcacgtagactacgcaagttccgtgcggggccgatccctcatctccagagacaattccaaaaatagtttatatctagacatgaataacctgaaaattgaggacacggccacatattattgtgcaagagatagagacggatatggtccaccacagatccagacttggagcggtcgatacctccacctttattctggaatagacgcctggggcctagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 500 - DNA, 405 bp, Artificial Sequence
  Description of Artificial Sequence: Synthetic polynucleotide
caggtgcagttggtggagtcgggcggaggcgtggtccagcctgggaagtccctgagactctcctgtgtagtctctaattttctcttcaataaacgtcacatgcactgggtccgccaggctccaggcaagggactagagtggatagcagtcatttcctctgatgccattcacgtagactacgcaagttccgtgcggggccgatccctcatctccagagacaattccaaaaatagtttatatctagacatgaataacctgaaaattgaggacacggccacatattattgtgcaagagatagagacggatatggtccaccacagatccagacttggagcggtcgatacctccacctttattctggaatagacgcctggggcctagggaccacggtcaccgtctcgagc

SEQ ID NO: 501 - protein, 484 aa, Artificial Sequence
  Description of Artificial Sequence: Synthetic polypeptide
MELGLSWVFLVALLRGVQCQVQLVESGGGVVQPGKSLRLSCVVSNFLFNKRHMHWVRQAPGKGLEWIAVISSDAIHVDYASSVRGRSLISRDNSKNSLYLDMNNLKIEDTATYYCARDRDGYGPPQIQTWSGRYLHLYSGIDAWGLGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 502 - protein, 135 aa, Artificial Sequence
  Description of Artificial Sequence: Synthetic polypeptide
QVQLVESGGGVVQPGKSLRLSCVVSNFLFNKRHMHWVRQAPGKGLEWIAVISSDAIHVDYASSVRGRSLISRDNSKNSLYLDMNNLKIEDTATYYCARDRDGYGPPQIQTWSGRYLHLYSGIDAWGLGTTVTVSS

SEQ ID NO: 503 - protein, 5 aa, Artificial Sequence
  Description of Artificial Sequence: Synthetic peptide
KRHMH

SEQ ID NO: 504 - protein, 17 aa, Artificial Sequence
  Description of Artificial Sequence: Synthetic peptide
VISSDAIHVDYASSVRG

SEQ ID NO: 505 - protein, 26 aa, Artificial Sequence
  Description of Artificial Sequence: Synthetic peptide
DRDGYGPPQIQTWSGRYLHLYSGIDA

SEQ ID NO: 506 - protein, 6 aa, Artificial Sequence
  Description of Artificial Sequence: Synthetic peptide
NFLFNK

SEQ ID NO: 507 - protein, 10 aa, Artificial Sequence
  Description of Artificial Sequence: Synthetic peptide
VISSDAIHVD

SEQ ID NO: 508 - DNA, 720 bp, Artificial Sequence
  Description of Artificial Sequence: Synthetic polynucleotide
atgaggctccctgctcagctcctggggctgctaatgctctggatacctgaattcactgcggacattgtgctgacccagagccccctctttctgtccgtcagtcctggacagccggcctccatctcctgtaagtctagtcagagcctccgacaaagtaatggaaagacatatttgtattggtacgtacaaaagtccggccagtctccacaacccctgatccaggaagtttccattcgcttctctggagtgccaggtagattcgctggcagcggatcagggacagacttcacactgaaaatcagccgggtggaggctgaagatgttggagtttatttctgcatgcaaagtaaagactttccactcacttttggcggagggaccaaggtggacctcaatcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 509 - DNA, 336 bp, Artificial Sequence
  Description of Artificial Sequence: Synthetic polynucleotide
gacattgtgctgacccagagccccctctttctgtccgtcagtcctggacagccggcctccatctcctgtaagtctagtcagagcctccgacaaagtaatggaaagacatatttgtattggtacgtacaaaagtccggccagtctccacaacccctgatccaggaagtttccattcgcttctctggagtgccaggtagattcgctggcagcggatcagggacagacttcacactgaaaatcagccgggtggaggctgaagatgttggagtttatttctgcatgcaaagtaaagactttccactcacttttggcggagggaccaaggtggacctcaat

SEQ ID NO: 510 - protein, 239 aa, Artificial Sequence
  Description of Artificial Sequence: Synthetic polypeptide
MRLPAQLLGLLMLWIPEFTADIVLTQSPLFLSVSPGQPASISCKSSQSLRQSNGKTYLYWYVQKSGQSPQPLIQEVSIRFSGVPGRFAGSGSGTDFTLKISRVEAEDVGVYFCMQSKDFPLTFGGGTKVDLNRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 511 - protein, 112 aa, Artificial Sequence
  Description of Artificial Sequence: Synthetic polypeptide
DIVLTQSPLFLSVSPGQPASISCKSSQSLRQSNGKTYLYWYVQKSGQSPQPLIQEVSIRFSGVPGRFAGSGSGTDFTLKISRVEAEDVGVYFCMQSKDFPLTFGGGTKVDLN

SEQ ID NO: 512 - protein, 16 aa, Artificial Sequence
  Description of Artificial Sequence: Synthetic peptide
KSSQSLRQSNGKTYLY

SEQ ID NO: 513 - protein, 7 aa, Artificial Sequence
  Description of Artificial Sequence: Synthetic peptide
EVSIRFS

SEQ ID NO: 514 - DNA, 1455 bp, Artificial Sequence
  Description of Artificial Sequence: Synthetic polynucleotide
atggaattggggctgagctgggttttcctcgttgctctcttaagaggtgtccagtgtcaggtgcagctggtggaatcgggaggaggcgtggtccagcctggaaagtccctcagactctcatgtgtcgtctctaatttcatctttaataaatatcctatgtattgggtccgccaggctccaggcaaggggctggagtgggtggcagccatctccgctgatgcctggcatgtagactacgcagcctccgtgaaggaccgatttctcatctccagagacaattccaagaatgctctatatttggaaatgaacaccctgagagttgaagacacgggtatctactactgtgcgagaaatatagaggagtttagtgttccacagttcgattcttggagcggtcgaagctactaccactattttgggatggacgtctggggccaagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 515 - DNA, 405 bp, Artificial Sequence
  Description of Artificial Sequence: Synthetic polynucleotide
caggtgcagctggtggaatcgggaggaggcgtggtccagcctggaaagtccctcagactctcatgtgtcgtctctaatttcatctttaataaatatcctatgtattgggtccgccaggctccaggcaaggggctggagtgggtggcagccatctccgctgatgcctggcatgtagactacgcagcctccgtgaaggaccgatttctcatctccagagacaattccaagaatgctctatatttggaaatgaacaccctgagagttgaagacacgggtatctactactgtgcgagaaatatagaggagtttagtgttccacagttcgattcttggagcggtcgaagctactaccactattttgggatggacgtctggggccaagggaccacggtcaccgtctcgagc

SEQ ID NO: 516 - protein, 484 aa, Artificial Sequence
  Description of Artificial Sequence: Synthetic polypeptide
MELGLSWVFLVALLRGVQCQVQLVESGGGVVQPGKSLRLSCVVSNFIFNKYPMYWVRQAPGKGLEWVAAISADAWHVDYAASVKDRFLISRDNSKNALYLEMNTLRVEDTGIYYCARNIEEFSVPQFDSWSGRSYYHYFGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 517 - protein, 135 aa, Artificial Sequence
  Description of Artificial Sequence: Synthetic polypeptide
QVQLVESGGGVVQPGKSLRLSCVVSNFIFNKYPMYWVRQAPGKGLEWVAAISADAWHVDYAASVKDRFLISRDNSKNALYLEMNTLRVEDTGIYYCARNIEEFSVPQFDSWSGRSYYHYFGMDVWGQGTTVTVSS

SEQ ID NO: 518 - protein, 17 aa, Artificial Sequence
  Description of Artificial Sequence: Synthetic peptide
AISADAWHVDYAASVKD

SEQ ID NO: 519 - protein, 26 aa, Artificial Sequence
  Description of Artificial Sequence: Synthetic peptide
NIEEFSVPQFDSWSGRSYYHYFGMDV

SEQ ID NO: 520 - protein, 6 aa, Artificial Sequence
  Description of Artificial Sequence: Synthetic peptide
NFIFNK

SEQ ID NO: 521 - protein, 10 aa, Artificial Sequence
  Description of Artificial Sequence: Synthetic peptide
AISADAWHVD

SEQ ID NO: 522 - DNA, 720 bp, Artificial Sequence
  Description of Artificial Sequence: Synthetic polynucleotide
atgaggctccctgctcagctcctggggctgctaatgctctggatacctgagttcgctgcagacattgtgatgactcagactcctgtctctctgtccgtcagtcttggacaggcggcctccatctcctgcagctccagtgagagtctcggacgtggtgatggaaggacctatttgcattggtaccgacagaagccaggccagactccacaattactcatgtatgaagtttctactcgattctctggagtgtccgacaggttcgctggcagcgggtcacgtacacaattcacattgaaaattagtcgggtggaggctgaagatgttggcgtttattactgcatgcaaagtagagacttcccaatcacttttggcggagggaccagggtggatctcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 523 - DNA, 336 bp, Artificial Sequence
  Description of Artificial Sequence: Synthetic polynucleotide
gacattgtgatgactcagactcctgtctctctgtccgtcagtcttggacaggcggcctccatctcctgcagctccagtgagagtctcggacgtggtgatggaaggacctatttgcattggtaccgacagaagccaggccagactccacaattactcatgtatgaagtttctactcgattctctggagtgtccgacaggttcgctggcagcgggtcacgtacacaattcacattgaaaattagtcgggtggaggctgaagatgttggcgtttattactgcatgcaaagtagagacttcccaatcacttttggcggagggaccagggtggatctcaaa

SEQ ID NO: 524 - protein, 239 aa, Artificial Sequence
  Description of Artificial Sequence: Synthetic polypeptide
MRLPAQLLGLLMLWIPEFAADIVMTQTPVSLSVSLGQAASISCSSSESLGRGDGRTYLHWYRQKPGQTPQLLMYEVSTRFSGVSDRFAGSGSRTQFTLKISRVEAEDVGVYYCMQSRDFPITFGGGTRVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 525 - protein, 112 aa, Artificial Sequence
  Description of Artificial Sequence: Synthetic polypeptide
DIVMTQTPVSLSVSLGQAASISCSSSESLGRGDGRTYLHWYRQKPGQTPQLLMYEVSTRFSGVSDRFAGSGSRTQFTLKISRVEAEDVGVYYCMQSRDFPITFGGGTRVDLK

SEQ ID NO: 526 - protein, 16 aa, Artificial Sequence
  Description of Artificial Sequence: Synthetic peptide
SSSESLGRGDGRTYLH

SEQ ID NO: 527 - protein, 7 aa, Artificial Sequence
  Description of Artificial Sequence: Synthetic peptide
EVSTRFS

SEQ ID NO: 528 - protein, 9 aa, Artificial Sequence
  Description of Artificial Sequence: Synthetic peptide
MQSRDFPIT

SEQ ID NO: 529 - DNA, 1455 bp, Artificial Sequence
  Description of Artificial Sequence: Synthetic polynucleotide
atggaattggggctgagctgggttttcctcgtcgttctcctaagaggtgtccactgtcaggtgcatctggtggagtcggggggaggcgtggtccaacctgggaagtccctaagactctcctgtgaaacctctggcttcatcttcaacgaatatcccatgtattggatccgccaggctccaggcaagggaccggagtgggtggccgccatctccgctgacgcctggcatgtggactacgcaggctccgtgcggggccgatttaccgtctccagagacaattctaagaattctctatatttagacatgaagagtctgaaagttgaagacacggctatatatttctgtgcgaaagatggggaggaacacaaggtaccacaattgcattcctggagcggacgaaacttatatcactacactggttttgacgtctggggcccagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 530 - DNA, 405 bp, Artificial Sequence
  Description of Artificial Sequence: Synthetic polynucleotide
caggtgcatctggtggagtcggggggaggcgtggtccaacctgggaagtccctaagactctcctgtgaaacctctggcttcatcttcaacgaatatcccatgtattggatccgccaggctccaggcaagggaccggagtgggtggccgccatctccgctgacgcctggcatgtggactacgcaggctccgtgcggggccgatttaccgtctccagagacaattctaagaattctctatatttagacatgaagagtctgaaagttgaagacacggctatatatttctgtgcgaaagatggggaggaacacaaggtaccacaattgcattcctggagcggacgaaacttatatcactacactggttttgacgtctggggcccagggaccacggtcaccgtctcgagc

SEQ ID NO: 531 - protein, 484 aa, Artificial Sequence
  Description of Artificial Sequence: Synthetic polypeptide
MELGLSWVFLVVLLRGVHCQVHLVESGGGVVQPGKSLRLSCETSGFIFNEYPMYWIRQAPGKGPEWVAAISADAWHVDYAGSVRGRFTVSRDNSKNSLYLDMKSLKVEDTAIYFCAKDGEEHKVPQLHSWSGRNLYHYTGFDVWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 532 - protein, 135 aa, Artificial Sequence
  Description of Artificial Sequence: Synthetic polypeptide
QVHLVESGGGVVQPGKSLRLSCETSGFIFNEYPMYWIRQAPGKGPEWVAAISADAWHVDYAGSVRGRFTVSRDNSKNSLYLDMKSLKVEDTAIYFCAKDGEEHKVPQLHSWSGRNLYHYTGFDVWGPGTTVTVSS

SEQ ID NO: 533 - protein, 5 aa, Artificial Sequence
  Description of Artificial Sequence: Synthetic peptide
EYPMY

SEQ ID NO: 534 - protein, 17 aa, Artificial Sequence
  Description of Artificial Sequence: Synthetic peptide
AISADAWHVDYAGSVRG

SEQ ID NO: 535 - protein, 26 aa, Artificial Sequence
  Description of Artificial Sequence: Synthetic peptide
DGEEHKVPQLHSWSGRNLYHYTGFDV

SEQ ID NO: 536 - protein, 6 aa, Artificial Sequence
  Description of Artificial Sequence: Synthetic peptide
GFIFNE

SEQ ID NO: 537 - DNA, 720 bp, Artificial Sequence
  Description of Artificial Sequence: Synthetic polynucleotide
atgaggctccctgctcagctcctggggctgctaatgctctggatacctgaacttgctgcagacattgtgatgacccagtctcctgtctctctgtccgtcaccctcggacagccggcctccatgtcctgcaagtccagtcagagtgtccgacagagtgatggcaagactttcttatattggtatcgacagaagccaggccagtctccacaactgttaatatatgagggttcgagtcgattctctggagtgtcagataggatctctggcagcgggtcagggacagacttcacactgaggatcagtcgagtggaggctgaggatgctggcgtttacttctgcttgcaaactaaagacttccccctcacttttggcggagggaccagggtggatctcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 538 - DNA, 336 bp, Artificial Sequence
  Description of Artificial Sequence: Synthetic polynucleotide
gacattgtgatgacccagtctcctgtctctctgtccgtcaccctcggacagccggcctccatgtcctgcaagtccagtcagagtgtccgacagagtgatggcaagactttcttatattggtatcgacagaagccaggccagtctccacaactgttaatatatgagggttcgagtcgattctctggagtgtcagataggatctctggcagcgggtcagggacagacttcacactgaggatcagtcgagtggaggctgaggatgctggcgtttacttctgcttgcaaactaaagacttccccctcacttttggcggagggaccagggtggatctcaaa

SEQ ID NO: 539 - protein, 239 aa, Artificial Sequence
  Description of Artificial Sequence: Synthetic polypeptide
MRLPAQLLGLLMLWIPELAADIVMTQSPVSLSVTLGQPASMSCKSSQSVRQSDGKTFLYWYRQKPGQSPQLLIYEGSSRFSGVSDRISGSGSGTDFTLRISRVEAEDAGVYFCLQTKDFPLTFGGGTRVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 540 - protein, 112 aa, Artificial Sequence
  Description of Artificial Sequence: Synthetic polypeptide
DIVMTQSPVSLSVTLGQPASMSCKSSQSVRQSDGKTFLYWYRQKPGQSPQLLIYEGSSRFSGVSDRISGSGSGTDFTLRISRVEAEDAGVYFCLQTKDFPLTFGGGTRVDLK

SEQ ID NO: 541 - protein, 16 aa, Artificial Sequence
  Description of Artificial Sequence: Synthetic peptide
KSSQSVRQSDGKTFLY

SEQ ID NO: 542 - protein, 7 aa, Artificial Sequence
  Description of Artificial Sequence: Synthetic peptide
EGSSRFS

SEQ ID NO: 543 - protein, 9 aa, Artificial Sequence
  Description of Artificial Sequence: Synthetic peptide
LQTKDFPLT

SEQ ID NO: 544 - DNA, 1455 bp, Artificial Sequence
  Description of Artificial Sequence: Synthetic polynucleotide
atggaattggggctgagctgggttttcctcgtcgttctcctaagaggtgtccactgtcaggtgcatctggtggagtcggggggaggcgttgtccaacctggaaagtccctaagactctcctgtgaaacctctggcttcatcttcaatcaatatcccatgtattgggtccgccaggctccaggcaagggaccggagtgggtggccgccatctccgctgatgcctggcatgtggactacccaggctccgtgcggggccgatttaccgtctccagagacaattccaagagttctctatatttagacatgaagagtctgaaagttgaagacacggctatatatttctgtgcgaaagatggggaggaacacaaggtaccacaattgcattcctggagcggacgaaacttatatcactacactggttttgacgtctggggcccagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 545 - DNA, 405 bp, Artificial Sequence
  Description of Artificial Sequence: Synthetic polynucleotide
caggtgcatctggtggagtcggggggaggcgttgtccaacctggaaagtccctaagactctcctgtgaaacctctggcttcatcttcaatcaatatcccatgtattgggtccgccaggctccaggcaagggaccggagtgggtggccgccatctccgctgatgcctggcatgtggactacccaggctccgtgcggggccgatttaccgtctccagagacaattccaagagttctctatatttagacatgaagagtctgaaagttgaagacacggctatatatttctgtgcgaaagatggggaggaacacaaggtaccacaattgcattcctggagcggacgaaacttatatcactacactggttttgacgtctggggcccagggaccacggtcaccgtctcgagc

SEQ ID NO: 546 - protein, 484 aa, Artificial Sequence
  Description of Artificial Sequence: Synthetic polypeptide
MELGLSWVFLVVLLRGVHCQVHLVESGGGVVQPGKSLRLSCETSGFIFNQYPMYWVRQAPGKGPEWVAAISADAWHVDYPGSVRGRFTVSRDNSKSSLYLDMKSLKVEDTAIYFCAKDGEEHKVPQLHSWSGRNLYHYTGFDVWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 547 - protein, 135 aa, Artificial Sequence
  Description of Artificial Sequence: Synthetic polypeptide
QVHLVESGGGVVQPGKSLRLSCETSGFIFNQYPMYWVRQAPGKGPEWVAAISADAWHVDYPGSVRGRFTVSRDNSKSSLYLDMKSLKVEDTAIYFCAKDGEEHKVPQLHSWSGRNLYHYTGFDVWGPGTTVTVSS

SEQ ID NO: 548 - protein, 5 aa, Artificial Sequence
  Description of Artificial Sequence: Synthetic peptide
QYPMY

SEQ ID NO: 549 - protein, 17 aa, Artificial Sequence
  Description of Artificial Sequence: Synthetic peptide
AISADAWHVDYPGSVRG

SEQ ID NO: 550 - protein, 6 aa, Artificial Sequence
  Description of Artificial Sequence: Synthetic peptide
GFIFNQ

SEQ ID NO: 551 - DNA, 720 bp, Artificial Sequence
  Description of Artificial Sequence: Synthetic polynucleotide
atgaggctccctgctcagctcctggggctgctaatgctctggatacctgaacttgctgcagacattgtgatgacccagtctcctgtctctctgtccgtcaccctcggacagccggcctccatgtcctgcaagtccagtcagactgtccgacagagtgatggcaagactttcttatattggtatcgacagaaggcaggccagtctccacaactgttaatatatgagggttcgaatcgattctctggagtgtcagataggatctctggcagcgggtcggggacagatttcacactgagaatcagtcgagtggaggctgaggatgttggcgtttatttctgcctgcaaactaaagacttccccctcacttttggcggagggaccagggtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 552 - DNA, 336 bp, Artificial Sequence
  Description of Artificial Sequence: Synthetic polynucleotide
gacattgtgatgacccagtctcctgtctctctgtccgtcaccctcggacagccggcctccatgtcctgcaagtccagtcagactgtccgacagagtgatggcaagactttcttatattggtatcgacagaaggcaggccagtctccacaactgttaatatatgagggttcgaatcgattctctggagtgtcagataggatctctggcagcgggtcggggacagatttcacactgagaatcagtcgagtggaggctgaggatgttggcgtttatttctgcctgcaaactaaagacttccccctcacttttggcggagggaccagggtggatatcaaa

SEQ ID NO: 553 - protein, 239 aa, Artificial Sequence
  Description of Artificial Sequence: Synthetic polypeptide
MRLPAQLLGLLMLWIPELAADIVMTQSPVSLSVTLGQPASMSCKSSQTVRQSDGKTFLYWYRQKAGQSPQLLIYEGSNRFSGVSDRISGSGSGTDFTLRISRVEAEDVGVYFCLQTKDFPLTFGGGTRVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 554 - protein, 112 aa, Artificial Sequence
  Description of Artificial Sequence: Synthetic polypeptide
DIVMTQSPVSLSVTLGQPASMSCKSSQTVRQSDGKTFLYWYRQKAGQSPQLLIYEGSNRFSGVSDRISGSGSGTDFTLRISRVEAEDVGVYFCLQTKDFPLTFGGGTRVDIK

SEQ ID NO: 555 - protein, 16 aa, Artificial Sequence
  Description of Artificial Sequence: Synthetic peptide
KSSQTVRQSDGKTFLY

SEQ ID NO: 556 - protein, 7 aa, Artificial Sequence
  Description of Artificial Sequence: Synthetic peptide
EGSNRFS

SEQ ID NO: 557 - DNA, 1455 bp, Artificial Sequence
  Description of Artificial Sequence: Synthetic polynucleotide
atggaattggggctgagctgggttttcctcgtcgctctcctaagaggtgtccactgtgaagtgcatctggtggagtcggggggaggcgtggtccaacctggaaagtccctcagactctcctgtgtaacttctggcttcatcttcaaacaatatcctatgtattggatccgccaggctccaggcaaggggctggagtgggtggccgccatctccgctgatgcctggcatgtggactacgcaggctccgtgcggggccgatttaccgtctccagagacaactccaagaattctctatatttagacatgaacagtctgacagttgaagacacggctatatatttctgtgcgaaagatggggaagaacacgaagtaccacagttgcactcctggagcggacgaaatttatatcactacactggtgtggacatctggggcccagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 558 - DNA, 405 bp, Artificial Sequence
  Description of Artificial Sequence: Synthetic polynucleotide
gaagtgcatctggtggagtcggggggaggcgtggtccaacctggaaagtccctcagactctcctgtgtaacttctggcttcatcttcaaacaatatcctatgtattggatccgccaggctccaggcaaggggctggagtgggtggccgccatctccgctgatgcctggcatgtggactacgcaggctccgtgcggggccgatttaccgtctccagagacaactccaagaattctctatatttagacatgaacagtctgacagttgaagacacggctatatatttctgtgcgaaagatggggaagaacacgaagtaccacagttgcactcctggagcggacgaaatttatatcactacactggtgtggacatctggggcccagggaccacggtcaccgtctcgagc

SEQ ID NO: 559 - protein, 484 aa, Artificial Sequence
  Description of Artificial Sequence: Synthetic polypeptide
MELGLSWVFLVALLRGVHCEVHLVESGGGVVQPGKSLRLSCVTSGFIFKQYPMYWIRQAPGKGLEWVAAISADAWHVDYAGSVRGRFTVSRDNSKNSLYLDMNSLTVEDTAIYFCAKDGEEHEVPQLHSWSGRNLYHYTGVDIWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 560 - protein, 135 aa, Artificial Sequence
  Description of Artificial Sequence: Synthetic polypeptide
EVHLVESGGGVVQPGKSLRLSCVTSGFIFKQYPMYWIRQAPGKGLEWVAAISADAWHVDYAGSVRGRFTVSRDNSKNSLYLDMNSLTVEDTAIYFCAKDGEEHEVPQLHSWSGRNLYHYTGVDIWGPGTTVTVSS

SEQ ID NO: 561 - protein, 26 aa, Artificial Sequence
  Description of Artificial Sequence: Synthetic peptide
DGEEHEVPQLHSWSGRNLYHYTGVDI

SEQ ID NO: 562 - protein, 6 aa, Artificial Sequence
  Description of Artificial Sequence: Synthetic peptide
GFIFKQ

SEQ ID NO: 563 - DNA, 720 bp, Artificial Sequence
  Description of Artificial Sequence: Synthetic polynucleotide
atgaggctccctgctcagctcctggggctgctaatgctctggatacctgaacttactgcagacattgtgatgacccagactcctgtctctctgtccgtcaccctcggacagccggcctccatgtcctgtaagtccagtcagagcctccgacaaagtgatggcaagactttcttgtattggtatcgacagaaggcaggccagtctccacaactcctaatatctgaggcttcgaatcgattctctggagtgtcagataggttctctggcagcggttcagggacagacttcacactgaaaatcagtcgggtggaggctgaggatgttggcatttatttctgcatgcaaactaaagacttccccctcacttttggcggagggaccaaggtggatctcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 564 - DNA, 336 bp, Artificial Sequence
  Description of Artificial Sequence: Synthetic polynucleotide
gacattgtgatgacccagactcctgtctctctgtccgtcaccctcggacagccggcctccatgtcctgtaagtccagtcagagcctccgacaaagtgatggcaagactttcttgtattggtatcgacagaaggcaggccagtctccacaactcctaatatctgaggcttcgaatcgattctctggagtgtcagataggttctctggcagcggttcagggacagacttcacactgaaaatcagtcgggtggaggctgaggatgttggcatttatttctgcatgcaaactaaagacttccccctcacttttggcggagggaccaaggtggatctcaaa

SEQ ID NO: 565 - protein, 239 aa, Artificial Sequence
  Description of Artificial Sequence: Synthetic polypeptide
MRLPAQLLGLLMLWIPELTADIVMTQTPVSLSVTLGQPASMSCKSSQSLRQSDGKTFLYWYRQKAGQSPQLLISEASNRFSGVSDRFSGSGSGTDFTLKISRVEAEDVGIYFCMQTKDFPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 566 - protein, 112 aa, Artificial Sequence
  Description of Artificial Sequence: Synthetic polypeptide
DIVMTQTPVSLSVTLGQPASMSCKSSQSLRQSDGKTFLYWYRQKAGQSPQLLISEASNRFSGVSDRFSGSGSGTDFTLKISRVEAEDVGIYFCMQTKDFPLTFGGGTKVDLK

SEQ ID NO: 567 - protein, 16 aa, Artificial Sequence
  Description of Artificial Sequence: Synthetic peptide
KSSQSLRQSDGKTFLY

SEQ ID NO: 568 - protein, 7 aa, Artificial Sequence
  Description of Artificial Sequence: Synthetic peptide
EASNRFS

SEQ ID NO: 569 - protein, 9 aa, Artificial Sequence
  Description of Artificial Sequence: Synthetic peptide
MQTKDFPLT

SEQ ID NO: 570 - DNA, 1455 bp, Artificial Sequence
  Description of Artificial Sequence: Synthetic polynucleotide
atggaattggggctgagctgggttttcctcgtcgctctcctaagaggtgtccactgtgaggtgcgtctgatggagtcggggggaggcgtggtccagcctgggaagtccctcagactctcctgtgtaacctctggcttcatcttcaaaaaatatcctatgtactggatccgccaggctccaggcaaggggctggagtgggtggccgccatctccgctgatgcctggcatgtggactacccaggctccgtgcggggccgatttaccgtctcaagagacaactccaagaattctctatatttagacatgaatagtctgacagtagaagacacggctatatatttttgtgcgaaagatggggaggaacacgaagtcccacaactgcactcctggagcggacgaaatttatatcactacactggtgtagacgtctggggcccagggaccacggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 571 - DNA, 405 bp, Artificial Sequence
  Description of Artificial Sequence: Synthetic polynucleotide
gaggtgcgtctgatggagtcggggggaggcgtggtccagcctgggaagtccctcagactctcctgtgtaacctctggcttcatcttcaaaaaatatcctatgtactggatccgccaggctccaggcaaggggctggagtgggtggccgccatctccgctgatgcctggcatgtggactacccaggctccgtgcggggccgatttaccgtctcaagagacaactccaagaattctctatatttagacatgaatagtctgacagtagaagacacggctatatatttttgtgcgaaagatggggaggaacacgaagtcccacaactgcactcctggagcggacgaaatttatatcactacactggtgtagacgtctggggcccagggaccacggtcaccgtctcgagc

SEQ ID NO: 572 - protein, 484 aa, Artificial Sequence
  Description of Artificial Sequence: Synthetic polypeptide
MELGLSWVFLVALLRGVHCEVRLMESGGGVVQPGKSLRLSCVTSGFIFKKYPMYWIRQAPGKGLEWVAAISADAWHVDYPGSVRGRFTVSRDNSKNSLYLDMNSLTVEDTAIYFCAKDGEEHEVPQLHSWSGRNLYHYTGVDVWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 573 - protein, 135 aa, Artificial Sequence
  Description of Artificial Sequence: Synthetic polypeptide
EVRLMESGGGVVQPGKSLRLSCVTSGFIFKKYPMYWIRQAPGKGLEWVAAISADAWHVDYPGSVRGRFTVSRDNSKNSLYLDMNSLTVEDTAIYFCAKDGEEHEVPQLHSWSGRNLYHYTGVDVWGPGTTVTVSS

SEQ ID NO: 574 - protein, 26 aa, Artificial Sequence
  Description of Artificial Sequence: Synthetic peptide
DGEEHEVPQLHSWSGRNLYHYTGVDV

SEQ ID NO: 575 - protein, 6 aa, Artificial Sequence
  Description of Artificial Sequence: Synthetic peptide
GFIFKK

SEQ ID NO: 576 - DNA, 720 bp, Artificial Sequence
  Description of Artificial Sequence: Synthetic polynucleotide
atgaggctccctgctcagctcctggggctgctaatgctctggatacctgaagtgactgcagacattgtgatgacccagactcctgtctctgtgtccgtcaccctcggacagccggcctccatgtcctgcaagtccagtcagagcgtccgacaaagtgatggcaagacttttttatattggtatcgacagaaggcaggccagtctccacaactcttaatatatgaggcttcgaagcgattctctggagtgtcagataggttctctggcagcgggtcagggacagacttcacactgaaaatcagtcgggtgggggctgaggatgttggcgtttatttctgcatgcaaactaaagacttcccccttacttttggcggagggaccaaggtggatctcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 577 - DNA, 336 bp, Artificial Sequence
  Description of Artificial Sequence: Synthetic polynucleotide
gacattgtgatgacccagactcctgtctctgtgtccgtcaccctcggacagccggcctccatgtcctgcaagtccagtcagagcgtccgacaaagtgatggcaagacttttttatattggtatcgacagaaggcaggccagtctccacaactcttaatatatgaggcttcgaagcgattctctggagtgtcagataggttctctggcagcgggtcagggacagacttcacactgaaaatcagtcgggtgggggctgaggatgttggcgtttatttctgcatgcaaactaaagacttcccccttacttttggcggagggaccaaggtggatctcaaa

SEQ ID NO: 578 - protein, 239 aa, Artificial Sequence
  Description of Artificial Sequence: Synthetic polypeptide
MRLPAQLLGLLMLWIPEVTADIVMTQTPVSVSVTLGQPASMSCKSSQSVRQSDGKTFLYWYRQKAGQSPQLLIYEASKRFSGVSDRFSGSGSGTDFTLKISRVGAEDVGVYFCMQTKDFPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 579 - protein, 112 aa, Artificial Sequence
  Description of Artificial Sequence: Synthetic polypeptide
DIVMTQTPVSVSVTLGQPASMSCKSSQSVRQSDGKTFLYWYRQKAGQSPQLLIYEASKRFSGVSDRFSGSGSGTDFTLKISRVGAEDVGVYFCMQTKDFPLTFGGGTKVDLK

SEQ ID NO: 580 - protein, 7 aa, Artificial Sequence
  Description of Artificial Sequence: Synthetic peptide
EASKRFS

SEQ ID NO: 581 - DNA, 693 bp, Artificial Sequence
  Description of Artificial Sequence: Synthetic polynucleotide
atggcctgggctctgctcctcctcaccctcctcactcagggcacaggggcctgggcccagtctgccctgactcagcctccctccgcgtccgggtctcctggacagtcaatcaccatctcctgcactggaaatatcaataactttgtctcctggtaccaacaacaccctggcaaggcccccaaactcgtcatttatggggtcaataagcgcccctcaggtgtccctgatcgtttttctggctccaagtctggcaacgcggcctccctgaccgtctctggactccagactgacgatgaggctgtctattactgcggctcacttgcaggcaactgggatgtggttttcggcggagggaccaagttgactgtcctgggtcagcccatggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcatag

SEQ ID NO: 582 - DNA, 315 bp, Artificial Sequence
  Description of Artificial Sequence: Synthetic polynucleotide
cagtctgccctgactcagcctccctccgcgtccgggtctcctggacagtcaatcaccatctcctgcactggaaatatcaataactttgtctcctggtaccaacaacaccctggcaaggcccccaaactcgtcatttatggggtcaataagcgcccctcaggtgtccctgatcgtttttctggctccaagtctggcaacgcggcctccctgaccgtctctggactccagactgacgatgaggctgtctattactgcggctcacttgcaggcaactgggatgtggttttcggcggagggaccaagttgactgtcctg

SEQ ID NO: 583 - protein, 230 aa, Artificial Sequence
  Description of Artificial Sequence: Synthetic polypeptide
MAWALLLLTLLTQGTGAWAQSALTQPPSASGSPGQSITISCTGNINNFVSWYQQHPGKAPKLVIYGVNKRPSGVPDRFSGSKSGNAASLTVSGLQTDDEAVYYCGSLAGNWDVVFGGGTKLTVLGQPMAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 584 - protein, 105 aa, Artificial Sequence
  Description of Artificial Sequence: Synthetic polypeptide
QSALTQPPSASGSPGQSITISCTGNINNFVSWYQQHPGKAPKLVIYGVNKRPSGVPDRFSGSKSGNAASLTVSGLQTDDEAVYYCGSLAGNWDVVFGGGTKLTVL

SEQ ID NO: 585 - DNA, 24 bp, Artificial Sequence
  Description of Artificial Sequence: Synthetic oligonucleotide
actatggactggatttggaggatc

SEQ ID NO: 586 - DNA, 26 bp, Artificial Sequence
  Description of Artificial Sequence: Synthetic oligonucleotide
aacatgaaacacctgtggttcttcct

SEQ ID NO: 587 - DNA, 24 bp, Artificial Sequence
  Description of Artificial Sequence: Synthetic oligonucleotide
ggaagtagtccttgaccaggcagc

SEQ ID NO: 588 - DNA, 20 bp, Artificial Sequence
  Description of Artificial Sequence: Synthetic oligonucleotide
atgaggctccctgctcagct

SEQ ID NO: 589 - DNA, 21 bp, Artificial Sequence
  Description of Artificial Sequence: Synthetic oligonucleotide
ccccagctcagcttctcttcc

SEQ ID NO: 590 - DNA, 22 bp, Artificial Sequence
  Description of Artificial Sequence: Synthetic oligonucleotide
ccttggatagaagttattcagc

SEQ ID NO: 591 - DNA, 18 bp, Artificial Sequence
  Description of Artificial Sequence: Synthetic oligonucleotide
catggcctgggctctgct

SEQ ID NO: 592 - DNA, 19 bp, Artificial Sequence
  Description of Artificial Sequence: Synthetic oligonucleotide
ccatggcctggatccctct

SEQ ID NO: 593 - DNA, 22 bp, Artificial Sequence
  Description of Artificial Sequence: Synthetic oligonucleotide
ccttcatgcgtgacctggcagc

SEQ ID NO: 594 - protein, 6 aa, Artificial Sequence
  Description of Artificial Sequence: Synthetic peptide
ELDKWA

SEQ ID NO: 595 - protein, 30 aa, Artificial Sequence
  Description of Artificial Sequence: Synthetic polypeptide
AREAGGPIWHDDVKYYDFNDGYYNYHYMDV

SEQ ID NO: 596 - protein, 17 aa, Artificial Sequence
  Description of Artificial Sequence: Synthetic peptide
ARDRRAVPIATDNWLDP

SEQ ID NO: 597 - protein, 17 aa, Artificial Sequence
  Description of Artificial Sequence: Synthetic peptide
TRDRRVVPMATDNWLDP

SEQ ID NO: 598 - protein, 15 aa, Artificial Sequence
  Description of Artificial Sequence: Synthetic peptide
AAGAVGADSGSWFDP

SEQ ID NO: 599 - protein, 30 aa, Artificial Sequence
  Description of Artificial Sequence: Synthetic polypeptide
VREAGGPDYRNGYNYYDFYDGYYNYHYMDV

SEQ ID NO: 600 - protein, 110 aa, Artificial Sequence
  Description of Artificial Sequence: Synthetic polypeptide
SYELTQPPSVSVSPGQTASITCSGSKLGDKYVSWYQLRPGQSPILVMYENDRRPSGIPERFSGSNSGDTATLTISGTQALDEADFYCQAWETTTTTFVFFGGGTQLTVLG

SEQ ID NO: 601 - protein, 111 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLG

SEQ ID NO: 602 - protein, 111 aa, Artificial Sequence
  Description of Artificial Sequence: Synthetic polypeptide
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVLG

SEQ ID NO: 603 - DNA, 1445 bp, Artificial Sequence
  Description of Artificial Sequence: Synthetic polynucleotide
atgaaacacctgtggttcttccttctcctggtggcagctcccagatgggtcctgtccagatgcagttacaggagtcgggccccggactggtgaagccttcggaaaccctgtccctcacgtgcagtgtgtctggtgcctccataagtgacagttactggagctggatccggcggtccccagggaagggacttgagtggattgggtatgtccacaaaagcggcgacacaaattacatcccctccctcaagagtcgagtcaacttgtcgttagacacgtccaaaaatcaggtgtccctgagccttgtggccgcgaccgctgcggactcgggcaaatattattgcgcgagaacactgcacgggaggagaatttatggaatcgttgccttcaatgagtggttcacctacttctacatggacgtctggggcaatgggactcaggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 604 - protein, 481 aa, Artificial Sequence
  Description of Artificial Sequence: Synthetic polypeptide
MKHLWFFLLLVAAPRWVLSQMQLQESGPGLVKPSETLSLTCSVSGASISDSYWSWIRRSPGKGLEWIGYVHKSGDTNYIPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 605 - DNA, 401 bp, Artificial Sequence
  Description of Artificial Sequence: Synthetic polynucleotide
cagcgattagtggagtctgggggaggcgtggtccagcctgggtcgtccctgagactctcctgtgcagcgtccggattcgacttcagtagacaaggcatgcactgggtccgccaggctccaggccaggggctggagtgggtggcatttattaaatatgatggaagtgagaaatatcatgctgactccgtatggggccgactcagcatctccagagacaattccaaggatacgctttatctccaaatgaatagcctgagagtcgaggacacggctacatatttttgtgtgagagaggctggtgggcccgactaccgtaatgggtacaactattacgatttctatgatggttattataactaccactatatggacgtctggggcaaagggaccacggtcaccgt

SEQ ID NO: 606 - DNA, 404 bp, Artificial Sequence
  Description of Artificial Sequence: Synthetic polynucleotide
caggaacaactggtggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgt

SEQ ID NO: 607 - DNA, 404 bp, Artificial Sequence; identical to SEQ ID NO: 606
  Description of Artificial Sequence: Synthetic polynucleotide

SEQ ID NO: 608 - DNA, 404 bp, Artificial Sequence
  Description of Artificial Sequence: Synthetic polynucleotide
caggaacaactgttggagtctgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcaaactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgt

SEQ ID NO: 609 - DNA, 404 bp, Artificial Sequence
  Description of Artificial Sequence: Synthetic polynucleotide
cacgaacaactggtggaggccgggggaggcgtggtccagccgggggggtccctgagactctcctgtttagcgtctggattcacgtttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctttatctgcaattcagcagcctgagagtcgaagacacggctatgttcttctgtgcgagagaggccggtgggccaatctggcatgacgacgtcaaatattacgattttaatgacggctactacaactatcactacatggacgtctggggcaaggggaccaaggtcaccgt

SEQ ID NO: 610 - DNA, 404 bp, Artificial Sequence
  Description of Artificial Sequence: Synthetic polynucleotide
caggaaaaactggtggagtctgggggaggcgtggtccagccgggggggtccctgagactctcctgtttagcgtctggattcacctttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactttatatctgcaattcagcagcctgaaagtcgaagacacggctatgttcttctgtgcgagagaggctggtgggccaatctggcatgacgacgtcaaatattacgattttaatgacggctactacaattaccactacatggacgtctggggcaaggggaccattgtcaccgt

SEQ ID NO: 611 - DNA, 404 bp, Artificial Sequence
  Description of Artificial Sequence: Synthetic polynucleotide
caggaaaaactggtggagtctgggggaggcgtggtccagccgggggggtccctgagactctcctgtttagcgtctggattcacctttcacaaatatggcatgcactgggtccgccaggctccaggcaagggcctggagtgggtggcactcatctcagatgacggaatgaggaaatatcattcagactccatgtggggccgagtcaccatctccagagacaattccaagaacactctatatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgt

SEQ ID NO: 612 - DNA, 325 bp, Artificial Sequence
  Description of Artificial Sequence: Synthetic polynucleotide
cagtctgccctgactcagcctgcctccgtgtctgggtctcctggacagtcgatcaccatctcctgcaatggaaccagcaatgatgttggtggctatgaatctgtctcctggtaccaacaacatcccggcaaagcccccaaagtcgtgatttatgatgtcagtaaacggccctcaggggtttctaatcgcttctctggctccaagtccggcaacacggcctccctgaccatctctgggctccaggctgaggacgagggtgactattactgcaagtctctgacaagcacgagacgtcgggttttcggcactgggaccaagctgaccg

SEQ ID NO: 613 - DNA, 325 bp, Artificial Sequence
  Description of Artificial Sequence: Synthetic polynucleotide
cagtctgccctgactcagcctgcctccgtgtctgggtctcctggacagacgatcaccatctcctgcaatggaaccagcagtgacgttggtggatttgactctgtctcctggtaccaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccg

SEQ ID NO: 614 - DNA, 325 bp, Artificial Sequence
  Description of Artificial Sequence: Synthetic polynucleotide
cagtctgccctgactcagcctgcctccgtgtctgggtctcctggacagacgatcaccatctcctgcaatggaaccagcagtgacgttggtggatttgactctgtctcctggtatcaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccg

SEQ ID NO: 615 - DNA, 325 bp, Artificial Sequence
  Description of Artificial Sequence: Synthetic polynucleotide
cagtctgccctgactcagcctgcctccgtgtctgggtctcctggacagacgatcaccatctcctgcaatggaaccagccgtgacgttggtggatttgactctgtctcctggtatcaacaatccccagggaaagcccccaaagtcatggtttttgatgtcagtcatcggccctcaggtatgtctaatcgcttctctggctccaagtccggcaacacggcctccctgaccatttctgggctccacattgaggacgagggcgattatttctgctcttcattgacagacagaagccatcgcatattcggcggcgggaccaagctgaccg

SEQ ID NO: 616 - DNA, 325 bp, Artificial Sequence
  Description of Artificial Sequence: Synthetic polynucleotide
cagtctgccctgactcagcctgcctccgtgtctgggtctcctggacagacgatcaccatctcctgcaatggaaccagaagtgacgttggtggatttgactctgtctcctggtaccaacaatccccagggagagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaagctgaccg

SEQ ID NO: 617 - DNA, 325 bp, Artificial Sequence; identical to SEQ ID NO: 614
  Description of Artificial Sequence: Synthetic polynucleotide

SEQ ID NO: 618 - DNA, 325 bp, Artificial Sequence
  Description of Artificial Sequence: Synthetic polynucleotide
cagtctgccctgactcagcctgcctccgtgtctgggtctcctggacagacgatcaccatctcctgcaatggaaccagaagtgacgttggtggatttgactctgtctcctggtaccaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaaggtgaccg

SEQ ID NO: 619 - protein, 134 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVT

SEQ ID NO: 620 - protein, 134 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTIVT

SEQ ID NO: 621 - protein, 134 aa, Artificial Sequence
  Description of Artificial Sequence: Synthetic polypeptide
HEQLVEAGGGVVQPGGSLRLSCLASGFTFHKYGMHWVRQAPGKGLEWVALISDDGMRKYHSDSMWGRVTISRDNSKNTLYLQFSSLRVEDTAMFFCAREAGGPIWHDDVKYYDFNDGYYNYHYMDVWGKGTKVT

SEQ ID NO: 622 - protein, 134 aa, Artificial Sequence
  Description of Artificial Sequence: Synthetic polypeptide
QEQLLESGGGVVQPGGSLRLSCLASGFTFHKYGMHWVRQAPGKGLEWVALISDDGMRKYHSNSMWGRVTISRDNSKNTLYLQFSSLKVEDTAMFFCAREAGGPIWHDDVKYYDFNDGYYNYHYMDVWGKGTTVT

SEQ ID NO: 623 - protein, 134 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVT

SEQ ID NO: 624 - protein, 133 aa, Artificial Sequence
  Description of Artificial Sequence: Synthetic polypeptide
QRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVT

SEQ ID NO: 625 - protein, 108 aa, Artificial Sequence
  Description of Artificial Sequence: Synthetic polypeptide
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLT

SEQ ID NO: 626 - protein, 108 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVT

SEQ ID NO: 627 - protein, 108 aa, Artificial Sequence
  Description of Artificial Sequence: Synthetic polypeptide
QSALTQPASVSGSPGQTITISCNGTSRDVGGFDSVSWYQQSPGKAPKVMVFDVSHRPSGMSNRFSGSKSGNTASLTISGLHIEDEGDYFCSSLTDRSHRIFGGGTKLT

SEQ ID NO: 628 - protein, 108 aa, Artificial Sequence
  Description of Artificial Sequence: Synthetic polypeptide
QSALTQPASVSGSPGQTITISCNGTRSDVGGFDSVSWYQQSPGRAPKVMVFDVSHRPSGISNRFSGSKSGNTASLTISGLHIEDEGDYFCSSLTDRSHRIFGGGTKLT

SEQ ID NO: 629 - protein, 108 aa, Artificial Sequence
  Description of Artificial Sequence: Synthetic polypeptide
QSALTQPASVSGSPGQTITISCNGTRSDVGGFDSVSWYQQSPGKAPKVMVFDVSHRPSGISNRFSGSKSGNTASLTISGLHIEDEGDYFCSSLTDRSHRIFGGGTKVT

SEQ ID NO: 630 - DNA, 84 bp, Artificial Sequence
  Description of Artificial Sequence: Synthetic oligonucleotide
gaggctggtgggccaatctggcatgacgacgtcaaatattacgattttaatgacggctactacaattaccactacatggacgtc

SEQ ID NO: 631 - protein, 230 aa, Artificial Sequence
  Description of Artificial Sequence: Synthetic polypeptide
MAWTFLLLGLLSHCTASVTSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 632 - protein, 6 aa, Artificial Sequence
  Description of Artificial Sequence: Synthetic 6xHis tag
HHHHHH

SEQ ID NO: 633 - DNA, 480 bp, Artificial Sequence
  Description of Artificial Sequence: Synthetic polynucleotide
atggactggatttggaggatcctcttcttggtggcagcagttgcaagtgcccactcgcaggtgcagctggtgcagtctgggccggaggtgaagaagcctgggtcctcagtgaaggtctcctgcaaggcctctggaaacaccttcagtaaatatgatgtccactgggtacgacaggccactggacaggggcttgaatgggtgggatggatgagtcatgagggtgataagacagaatctgcacagagatttaagggccgagtcaccttcacgagggacacttccgcaagcacagcctacatggaactgcgcggcctgacatctgacgacacggccatctattattgtacgagaggctcaaaacatcgtttgcgagactacgttctctacgatgactacggcttaattaattatcaagagtggaatgactaccttgaatttttggacgtctggggccatggaaccgcggtcaccgtctcctca

SEQ ID NO: 634 - DNA, 480 bp, Artificial Sequence
  Description of Artificial Sequence: Synthetic polynucleotide
atggactggatttggaggatcctcttcttggtggcagcagttgcaagtgcccactcgcaggtgcagctggtgcagtctgggcctgaggtgaagaagcctgggtcctcagtgaaggtctcctgcaaggcctctggaaacaccttcagtaaatatgatgtccactgggtacgacaggccactggacaggggcttgaatgggtgggatggattagtcatgagcgtgataagacagaatctgcacagagatttaagggccgagtcaccttcacgagggacacttccgcaaccacagcctacatggaactgcgcggcctgacatctgacgacacggccatttattattgtacgagaggctcaaaacatcgcttgcgagactacgttctctacgatgactacggcttaattaattatcaagagtggaatgactaccttgaatttttggacgtctggggccatggaaccgcggtcaccgtctcctca

SEQ ID NO: 635 - DNA, 480 bp, Artificial Sequence
  Description of Artificial Sequence: Synthetic polynucleotide
atggactggatttggaggatcctcttcttggtggcagcagttgcaagtgcccacgcgcaggtgcagctggagcagtctggggctgaggtgaagaagcctgggtcctcagtgaaggtctcctgcaaggcctctggaaacaccttcagtaaatatgatgtccactgggtacgacaggccactggacaggggcttgaatgggtgggatggatgagtcatgagggtgataagacagaatctgcacagagatttaaggggcgagtcaccttcacgagggacacttccgcaagcacagcctacatggaactgcgcggcctgacatctgacgacacggccatttattattgtacgagaggttcaaaacatcgcttgcgagactacgttctctacgatgactacggcttaattaattatcaagagtggaatgactaccttgaatttttggacgtctggggccatggaaccgcggtcaccgtctcctca

SEQ ID NO: 636 - DNA, 480 bp, Artificial Sequence
  Description of Artificial Sequence: Synthetic polynucleotide
atggactggatttggaggatcctcttcttggtggcagcagttgcaagtgcccactcgcaggtgcagctggtgcagtctggggctgaggtgaagaagcctgggtcctcagtgaaggtctcctgcaaggcctctggaaacaccttcaggaaatatgatgtccactgggtacgacaggccactggacaggggcttgaatgggtgggatggatgagtcatgagggtgataagacagaatctgcacagagatttaagggccgagtctctttcacgagggacaattccgcaagcacagcctacattgaactgcgcggcctgacatctgacgacacggccatttattattgtaccggaggctcaaaacatcgcttgcgagactacgttctctacgatgattacggcctaataaatcagcaagagtggaatgactaccttgaatttttggacgtctggggccatggaaccgcggtcaccgtctcctca

SEQ ID NO: 637 - DNA, 396 bp, Artificial Sequence
  Description of Artificial Sequence: Synthetic polynucleotide
atgaggctccctgctcagctcctggggctgctaatgctctgggtctctggatccagtgcggatactgtcgtgactcagtctccactctccctgcccgtcacccctggagaggcggcctccatgtcctgttcgtcgactcagagcctccggcatagtaatggagccaactatttggcttggtatcagcacaaaccggggcagtctccacgactcctaatccgtttaggttctcaacgggcctccggggtccctgacagattcagtggcagtggatcaggcactcattttacactgaaaatcagtagagtggaggctgaagatgctgcaatttattattgcatgcaaggtctgaaccgtccctggacgttcggcaaggggaccaagttggaaatcaaa

SEQ ID NO: 638 - DNA, 396 bp, Artificial Sequence
  Description of Artificial Sequence: Synthetic polynucleotide
atgaggctccctgctcagctcctggggctgctaatgctctgggtctctggatccagtgcggatactgtcgtgactcagtctccactctccctgcccgtcacccctggagaggcggcctccatgtcctgtacgtcgactcagagcctccgtcatagtaatggagccaactatttggcttggtaccagcacaaaccagggcagtctccacgactcctaatccgtttaggttctcaacgggcctccggggtccctgacagattcagtggcagtggatcaggcactcattttacactgaaaatcagtcgagtggagcctgaagatgctgcaatttattattgcatgcaaggtctgaaccgtccctggacgttcggcaaggggaccaagttggaaatcaaa

SEQ ID NO: 639 - DNA, 396 bp, Artificial Sequence
  Description of Artificial Sequence: Synthetic polynucleotide
atgaggctccctgctcagctcctggggctgctaatgctctgggtctctggatccagtgcggatactgtcgtgactcagtctccactctccctgtccgtcacccctggagaggcggcctccatgtcctgtacgtcgactcagagcctccggcatagtaatggagccaactatttggcttggtaccagcacaaaccagggcagtctccacgactcctaatccgtttaggttctcaacgggcctccggggtccctgacagattcagtggcagtggatcaggcactcattttacactgaaaatcagtagagtggaggctgacgatgctgcaatttattattgcatgcaaggtctgaaccgtccctggacgttcggcaaggggaccaagttggagatcaaa

SEQ ID NO: 640 - DNA, 405 bp, Artificial Sequence
  Description of Artificial Sequence: Synthetic consensus sequence
caggaacaactggtggagtctgggggaggcgtggtccagccgggggggtccctgagactctcctgtttagcgtctggattcacatttcacaaatatggcatgcactgggtccgccaggctccaggcaagggcctggagtgggtggcactcatctcagatgacggaagtgaggaaatatcattcagactccatgtggggccgagtcaccatctccagagacaattccaagaacactctttatctgcaattcagcagcctgaaagtcgaagacacggctatgttcttctgtgcgagagaggctggtgggccaatctggcatgacgacgtcaaatattacgattttaatgacggctactacaactaccactacatggacgtctggggcaaggggaccacggtcaccgt

SEQ ID NO: 641 - DNA, 325 bp, Artificial Sequence
  Description of Artificial Sequence: Synthetic consensus sequence
cagtctgccctgactcagcctgcctccgtgtctgggtctcctggacagacgatcaccatctcctgcaatggaaccagcagtgacgttggtggatttgactctgtctcctggtaccaacaatccccagggaaagcccccaaagtcatggtttttgatgtcagtcatcggccctcaggtatctctaatcgcttctctggctccaagtccggcaacacggcctccctgaccatctctgggctccacattgaggacgagggcgattatttctgctcttcactgacagacagaagccatcgcatattcggcggcgggaccaagstgaccg

SEQ ID NO: 642 - protein, 134 aa, Artificial Sequence
  Description of Artificial Sequence: Synthetic consensus sequence
  MOD_RES (3)..(3): Lys, Gln or Arg
QEXLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVT

SEQ ID NO: 643 - protein, 108 aa, Artificial Sequence
  Description of Artificial Sequence: Synthetic consensus sequence
  MOD_RES (107)..(107): Leu or Val
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKXT

SEQ ID NO: 644 - DNA, 444 bp, Artificial Sequence
  Description of Artificial Sequence: Synthetic consensus sequence
cagytgcagytgcaggagtcgggcccaggactggtgaagccttcggagaccctgtccctcacktgcastgtgtctggtgmctccatraggggyrscgactggggcgakaatgattattactggggctggatccgscagtccccagggaagggrctggagtggattgggagtttgtcatatstcgcagagtcattasagsggsggstmcaccmactacaacccgtccctcaagagtcgagtcaccttgtcgwtmgacacgtccaaraatcaggtctccctgaggctkabytctgtgaccgccgcggacacggccatmtactattgtgcgcgawcactdcacggacggagaawtcatggtrtwtttgccttcaaagagtggtyccymtwccgggctggwtcgacgtctggggccagggaathchggtcaccgtctccwsctcctca

SEQ ID NO: 645 - protein, 147 aa, Artificial Sequence
  Description of Artificial Sequence: Synthetic consensus sequence
  MOD_RES (2)..(2): Met, Val, Leu, Pro, or Ser
  MOD_RES (23)..(23): Ser, Asn or Thr
  MOD_RES (27)..(27): Ala, Thr, Asp, Glu or Gly
  MOD_RES (30)..(30): Ser, Arg, Asn, Ala or Gly
  MOD_RES (32)..(32): Gly, Thr or not present
  MOD_RES (33)..(33): Glu, Asp or not present
  MOD_RES (36)..(36): Ala, Thr, Asp, Glu or not present
  MOD_RES (37)..(37): Cys, Gly, Lys, Asn or not present
  MOD_RES (39)..(39): Ser, Asn, Ala, Tyr or Phe
  MOD_RES (40)..(40): Tyr, Phe or His
  MOD_RES (57)..(57): Tyr, Gly, Ser or His
  MOD_RES (58)..(58): Val, Leu or Ile
  MOD_RES (60)..(60): Lys, Asp, His, Tyr or Trp
  MOD_RES (61)..(61): Ser, Cys, Thr or Arg
  MOD_RES (63)..(63): Gly, Ser, Arg or not present
  MOD_RES (64)..(64): Tyr, Phe or not present
  MOD_RES (65)..(65): Tyr, Trp or not present
  MOD_RES (66)..(66): Asn, Gly or not present
  MOD_RES (67)..(67): Thr, Ser or not present
  MOD_RES (69)..(69): Asp, Trp, Ala or Thr
  MOD_RES (71)..(71): Asn, Tyr, Phe, Leu or His
  MOD_RES (73)..(73): Ser, Ile, Asn or Lys
  MOD_RES (82)..(82): Leu, Phe, Ile or Met
  MOD_RES (90)..(90): Gln, Leu, Glu, Trp or Arg
  MOD_RES (94)..(94): Ser, Arg, Lys or Thr
  MOD_RES (96)..(96): Val, Thr, Asn, Ser or Ala
  MOD_RES (97)..(97): Ala, Gly, Asp, Ser, Asn or Phe
  MOD_RES (105)..(105): Lys, Ile, Thr or Val
  MOD_RES (111)..(111): Thr, Ala, Phe, Ser or His
  MOD_RES (112)..(112): Leu, Lys, Asp, Gly or Arg
  MOD_RES (115)..(115): Arg, Lys, His or not present
  MOD_RES (116)..(116): Arg, Asp or not present
  MOD_RES (118)..(118): Tyr, Phe or not present
  MOD_RES (119)..(119): Gly, Glu, Asp, Met or Arg
  MOD_RES (120)..(120): Ile, Val or Leu
  MOD_RES (122)..(122): Ala, Val, Tyr or Pro
  MOD_RES (123)..(123): Phe, Leu, Tyr, Ile or Val
  MOD_RES (124)..(124): Asn, Lys, Gly, His, Tyr or Ala
  MOD_RES (125)..(125): Glu, Asp, His or Gly
  MOD_RES (137)..(137): Asn, Lys, Arg, Pro or Gln
  MOD_RES (139)..(139): Thr, Ile or not present
  MOD_RES (140)..(140): Leu, Pro or not present
  MOD_RES (141)..(141): Thr, Val, Ile or Leu
  MOD_RES (142)..(142): Gln, Ser, Ala, Thr, His or Leu
QXQLQESGPGLVKPSETLSLTCXVSGXSIXGXXWGXXDXXWGWIRQSPGKGLEWIGXXHXXGXXXXXGXTXYXPSLKSRVTXSLDTSKNXVSLXLXXVTAADTAXYYCARXXHGXXIXXXVXXXXWFTYFYMDVWGXGXXXXVTVSS

SEQ ID NO: 646 - DNA, 354 bp, Artificial Sequence
  Description of Artificial Sequence: Synthetic consensus sequence
gaaattgtgatgacgcagtctccmsmcwccstgtctgtgtctccaggagagacagccacratctcctgtagggmcagwcagcattgacattggcggtagbaarwmtgtakcctggtaccaacasaarccwggccaggcccccasrctcatcatytttgatamywataaccggccckcaggtrtccctgascgrttctctggctcccctgactccsgttctgggacmacggccactctgaccatcaccagtgtccagkccgargatgaggcmgactattactgcagttcaymtataggaagagtggmgktcccaccaatyggatsttcggcggagggaccaagstgaccgtcwta

SEQ ID NO: 647 - protein, 116 aa, Artificial Sequence
  Description of Artificial Sequence: Synthetic consensus sequence
  MOD_RES (9)..(9): Ser, Thr, Pro or Asp
  MOD_RES (10)..(10): Asp, Phe, Ser or Thr
  MOD_RES (11)..(11): Ile, Val, Met, Ala or Leu
  MOD_RES (24)..(24): Gly, Thr, Asn or Arg
  MOD_RES (25)..(25): Glu, Lys, Gly or Ala
  MOD_RES (26)..(26): Lys, Glu, Thr or Ser
  MOD_RES (28)..(28): Leu, Ile, Asn, Thr or Ser
  MOD_RES (29)..(29): Gly, Asp, Ile, Val or not present
  MOD_RES (30)..(30): Ser, Ile, Asn, Lys or not present
  MOD_RES (34)..(34): Arg, Asn or Lys
  MOD_RES (35)..(35): Ala, Ser, Phe or Asn
  MOD_RES (37)..(37): Gln, Ile, Ser or Ala
  MOD_RES (41)..(41): His, Gln, Tyr or Leu
  MOD_RES (42)..(42): Arg, Lys, His or Phe
  MOD_RES (48)..(48): Ser, Lys or Arg
  MOD_RES (53)..(53): Asn, Gly, Glu or Asp
  MOD_RES (54)..(54): Asn, Val, Thr or Ala
  MOD_RES (55)..(55): Gln, Asn, Asp, Tyr or Ser
  MOD_RES (56)..(56): Asp, Lys or Ser
  MOD_RES (59)..(59): Ser, Ala, Pro or Gly
  MOD_RES (61)..(61): Ile, Val or Phe
  MOD_RES (63)..(63): Glu, Asp, Gly or Ala
  MOD_RES (69)..(69): Pro, Lys, Arg or Gly
  MOD_RES (70)..(70): Asp, Gly, Ser or Tyr
  MOD_RES (72)..(72): Pro, Thr, Arg or not present
  MOD_RES (82)..(82): Thr, Ser or Asn
  MOD_RES (83)..(83): Ser, Asn, Gly or Arg
  MOD_RES (86)..(86): Ala, Thr or Ser
  MOD_RES (87)..(87): Gly, Glu or Asp
  MOD_RES (95)..(95): His, Ser, Gly or Gln
  MOD_RES (96)..(96): Ile, Ser or Gln
  MOD_RES (97)..(97): Trp, Tyr or Leu
  MOD_RES (98)..(98): Asp, Val, Phe or Glu
  MOD_RES (99)..(99): Ser, Ala, Gly or Glu
  MOD_RES (100)..(100): Arg, Asn or Trp
  MOD_RES (101)..(101): Val, Arg, Gly, Pro or not present
  MOD_RES (104)..(104): Lys, Asn, Asp or not present
  MOD_RES (105)..(105): Trp, Val or Arg
  MOD_RES (106)..(106): Val, Ile or Thr
  MOD_RES (109)..(109): Gly, Glu, Arg or Gln
EIVMTQSPXXXSVSPGETATISCXXXSXXXGGWXXVXWYQXXPGQAPXLIIFXXXXRPXGXPXRFSGSXXSXFGTTATLTIXXVQXXDEADYYCXXXXXXXPTXXXFGXGTKLTVL

SEQ ID NO: 648 - DNA, 480 bp, Artificial Sequence
  Description of Artificial Sequence: Synthetic consensus sequence
atggactggatttggaggatcctcttcttggtggcagcagttgcaagtgcccactcgcaggtgcagctggtgcagtctgggcctgaggtgaagaagcctgggtcctcagtgaaggtctcctgcaaggcctctggaaacaccttcagtaaatatgatgtccactgggtacgacaggccactggacaggggcttgaatgggtgggatggatgagtcatgagggtgataagacagaatctgcacagagatttaagggccgagtcaccttcacgagggacacttccgcaagcacagcctacatggaactgcgcggcctgacatctgacgacacggccatttattattgtacgagaggctcaaaacatcgcttgcgagactacgttctctacgatgactacggcttaattaattatcaagagtggaatgactaccttgaatttttggacgtctggggccatggaaccgcggtcaccgtctcctca

SEQ ID NO: 649 - protein, 141 aa, Artificial Sequence; identical to SEQ ID NO: 276
  Description of Artificial Sequence: Synthetic consensus sequence

SEQ ID NO: 650 - DNA, 396 bp, Artificial Sequence; identical to SEQ ID NO: 637
  Description of Artificial Sequence: Synthetic consensus sequence

SEQ ID NO: 651 - protein, 112 aa, Artificial Sequence; identical to SEQ ID NO: 285
  Description of Artificial Sequence: Synthetic consensus sequence

SEQ ID NO: 652 - DNA, 325 bp, Artificial Sequence
  Description of Artificial Sequence: Synthetic polynucleotide
cagtctgccctgactcagcctgcctccgtgtctgggtctcctggacagtcgatcaccatctcctgcaatggaaccagcaatgatgttggtggctatgaatctgtctcctggtaccaacaacatcccggcaaagcccccaaagtcgtgatttatgatgtcagtaaacggccctcaggggtttctaatcgcttctctggctccaagtccggcaacacggcctccctgaccatctctgggctccaggctgaggacgagggtgactattactgcaagtctctgacaagtacgagacgtcgggttttcggcactgggaccaagctgaccg

The invention claimed is:

1. A non-naturally occurring PGT-121 monoclonal antibody or antigen binding portion thereof comprising (a) a light chain variable region comprising three complementarity determining regions comprising the amino acid sequences of SEQ ID NOS: 150, 151 and 152 and (b) a heavy chain variable region comprising three complementarity determining regions comprising the amino acid sequences of SEQ ID NOS: 143, 144 and 145.

2. A non-naturally occurring PGT-121 monoclonal antibody or antigen binding portion thereof comprising (a) a light chain variable region comprising three complementarity determining regions having the amino acid sequences of SEQ ID NOS: 150, 151 and 152 and (b) a heavy chain variable region comprising three complementarity determining regions having the amino acid sequences of SEQ ID NOS: 90, 265 and 143.

3. An immortalized B cell clone expressing the antibody or antigen binding portion thereof of claim 1 or 2.

4. A pharmaceutical composition comprising the antibody or antigen binding portion thereof of claim 1 or 2 and a pharmaceutically acceptable carrier.

* * * * *